(12) United States Patent
Ayangbile et al.

(10) Patent No.: US 10,138,444 B2
(45) Date of Patent: Nov. 27, 2018

(54) BACTERIA AND ENZYMES PRODUCED THEREFROM AND METHODS OF USING SAME

(71) Applicant: Agri-King, Inc., Fulton, IL (US)

(72) Inventors: Gbenga Ayangbile, Fulton, IL (US); Mary Grzemski, Fulton, IL (US); James F. Tobey, Jr., Fulton, IL (US); David Spangler, Fulton, IL (US); Lucas Krueger, Fulton, IL (US)

(73) Assignee: Agri-King, Inc., Fulton, IL (US)

( * ) Notice: Subject to any disclaimer, the term of this patent is extended or adjusted under 35 U.S.C. 154(b) by 43 days.

(21) Appl. No.: 15/262,989

(22) Filed: Sep. 12, 2016

(65) Prior Publication Data

US 2017/0073620 A1    Mar. 16, 2017

Related U.S. Application Data

(60) Provisional application No. 62/218,039, filed on Sep. 14, 2015.

(51) Int. Cl.
| | |
|---|---|
| C12P 21/04 | (2006.01) |
| C12N 9/88 | (2006.01) |
| C12N 9/28 | (2006.01) |
| C12N 9/42 | (2006.01) |
| C11D 3/386 | (2006.01) |
| C12R 1/125 | (2006.01) |
| C12P 5/02 | (2006.01) |
| C12P 3/00 | (2006.01) |
| C12N 1/20 | (2006.01) |
| A61K 35/742 | (2015.01) |
| A23K 10/12 | (2016.01) |
| A23K 10/18 | (2016.01) |
| C02F 3/34 | (2006.01) |
| A23K 20/189 | (2016.01) |
| A23K 50/20 | (2016.01) |
| A23K 50/10 | (2016.01) |
| A23K 50/75 | (2016.01) |
| A23K 50/30 | (2016.01) |
| A23K 50/40 | (2016.01) |
| A23K 50/50 | (2016.01) |
| A23K 30/18 | (2016.01) |
| C02F 103/00 | (2006.01) |

(52) U.S. Cl.
CPC .......... *C11D 3/38645* (2013.01); *A23K 10/12* (2016.05); *A23K 10/18* (2016.05); *A23K 20/189* (2016.05); *A23K 30/18* (2016.05); *A23K 50/10* (2016.05); *A23K 50/20* (2016.05); *A23K 50/30* (2016.05); *A23K 50/40* (2016.05); *A23K 50/50* (2016.05); *A23K 50/75* (2016.05); *A61K 35/742* (2013.01); *C02F 3/34* (2013.01); *C12N 1/20* (2013.01); *C12N 9/2417* (2013.01); *C12N 9/2437* (2013.01); *C12P 3/00* (2013.01); *C12P 5/023* (2013.01); *C12R 1/125* (2013.01); *C12Y 302/01001* (2013.01); *C12Y 302/01004* (2013.01); *C02F 2103/005* (2013.01)

(58) Field of Classification Search
CPC .... A23K 10/18; C11D 3/38645; C12N 11/14; C12P 3/00; C12Y 402/01001
USPC ........................ 435/252.3, 232, 23.2, 254.11
See application file for complete search history.

(56) References Cited

U.S. PATENT DOCUMENTS

| | | |
|---|---|---|
| 8,828,124 B1 | 9/2014 | Mahajan |
| 9,040,271 B2 | 5/2015 | Foody |

FOREIGN PATENT DOCUMENTS

WO    2013167613 A1    11/2013

OTHER PUBLICATIONS

Group, Dr. Edward, "3 Ways to Reduce and Neutralize Flatulence www.globalhealingcenter.com/natural-health/3-ways-to-reduce-and-neutralize-flatulence", Published on May 1, 2013, 2 pages.
McDonald, Peter, "The Biochemistry of Silage" (1981).
Anderson, B.K., et al. "Conservation of Wilted and Unwilted Grass Ensiled in Air-Tight Metal Containers with and Wthout the Addition of Molasses", J.Sci. Fd. Agric. (1970) vol. 21, pp. 235-241.
Anderson, B.K., et al. "Conservation of Herbage of Varying Dry Matter Content in Air-tight Metal Containers with Reference to the Carbohydrate Fraction" J. Sci. Fd. Agric. (1970) vol. 21, pp. 228-234.
Das Neves, et al. "30th Symposium on Biotechnology for Fuels and Chemicals" U.S. Dept. of Energy, Office of the Biomass Program, May 2008, Poster presentation, 1 page.
Lourdes, Maria de, et al. "Gel Electrophoresis for Investigating Enzymes with Biotechnological Application" InTech (2012), pp. 97-110.
Novozymes, "Enzymes at work", brochure, 4th Edition 2013, 76 pages.
Noike, Tatsuya, et al. "Characteristics of Carbohydrate Degradation and the Rate-limiting Step in Anaerobic Digestion" Biotechnology and Bioengineering (1985) vol. XXVII, pp. 1482-1489.
Mahmood, Qaisar, et al. "The Rate-Limiting Step in Anaerobic Digestion in the Presence of Phosphine" Toxicology and Industrial Health (2006) 22: pp. 165-172.
Johnston, David B., et al. "Protease Increases Fermentation Rate and Ethanol Yield in Dry-Grind Ethanol Production" Bioresource Technology (2014) 154: pp. 18-25.

(Continued)

*Primary Examiner* — Tekchand Saidha
*Assistant Examiner* — Mohammad Y Meah
(74) *Attorney, Agent, or Firm* — McKee, Voorhees & Sease, PLC

(57) ABSTRACT

A bacteria referred to here as *Bacillus subtilis* 6A-1 is provided, compositions thereof and processes for use of the bacteria, spores, cells, extracts and enzymes. The compositions which comprise the bacteria, spores, cells, extracts and/or enzymes are capable of degrading polysaccharides. Such compositions are capable of degrading cellulose, including plant-produced cellulose, microcrystalline cellulose and carboxymethyl cellulose. The bacteria produces at least two cellulose-degrading protein fractions. Cellulose degrading activity continues across pH2 to pH13.

23 Claims, 16 Drawing Sheets

Specification includes a Sequence Listing.

(56) References Cited

OTHER PUBLICATIONS

Setlow, Barbara, et al. "Heat Killing of Bacillus Subtilis Spores in Water is Not Due to Oxidative Damage" Applied and Environmental Microbiology (1998) vol. 64, No. 10, pp. 4109-4112.
Ali, Safaa M., et al. "Co-Production of Cellulase and Xylanase Enzymes by Thermophilic Bacillus Subtilis 276NS" International Journal of Biotechnology for Wellness Industries (2013) vol. 2, pp. 65-74.
Barr, Brian, et al. "Identification of Two Functionally Different Classes of Exocellulases" Biochemistry (1996) 35: pp. 586-592.
Beauchemin, K.A., et al. "Evaluation of a Nonstarch Polysaccharidase Feed Enzyme in Dairy Cow Diets" J. Dairy Sci. (2000) 83: pp. 543-553.
Bhat, M.K., et al. "Cellulose Degrading Enzymes and Their Potential Industrial Applications" Biotechnology Advances (1997) vol. 15, No. 3 & 4, pp. 583-620.
Chan, Kwong-Yu, et al. "Studies on Cellulase Production by a Bacillus Subtilis" Antonie Van Leeuwenhoek (1987) 53: pp. 125-136.
Goyal, Varsha, et al. "Parametric Optimization of Cultural Conditions for Carboxymethyl Cellulase Production Using Pretreated Rice Straw by *Bacillus* sp. 313SI under Stationary and Shaking Conditions" Biotechnology Research International, vol. 2014, Article ID 651839, 7 pages.
Deka, Deepmoni, et al. "Enhanced Cellulase Production from Bacillus Subtilis by Optimizing Physical Parameters for Bioethanol Production" ISRN Biotechnology, vol. 2013, Article ID 965310, 11 pages.
Correia, Marcos Jose, et al. "Use of Remazol Blue Dyed Avicel for the Determination of Cellulolytic Activity in Basidiomycetes" Rev. Microbial. vol. 29 (1998) 3 pages.
Medve, Jozsef, "Hydrolysis of Microcyrstalline Cellulose by Cellobiohydrolase I and Endoglucanase II from Trichoderma reesei: Adsorption, Sugar Production Pattern, and Synergism of the Enzymes" Biotechnology and Bioengineering (1998) vol. 59, No. 5, pp. 621-634.
Kung Jr. L., et al. "The Effect of Treating Forages with Fibrolytic Enzymes on its Nutritive Value and Lactation Performance of Dairy Cows" J. Dairy Sci. (2000) 83: pp. 115-122.
Miller, Gail Lorenz, et al. "Use of Dinitrosalicylic Acid Reagent for Determination of Reducing Sugar" Analytical Chemistry (1959) vol. 31, No. 3, pp. 426-428.
Meng, F., et al. "Isolation and Characterization of Bacillus Subtilis Strain BY-3, a Thermophilic and Efficient Cellulase-Producing Bacterium on Untreated Plant Biomass" Letters in Applied Microbiology (2014) 59: pp. 306-312.
Priest, Fergus G. "Isolation and Identification of Aerobic Endospore-Forming Bacteria" Springer Science Business Media (1989), pp. 27-56.
Schulein, Martin, et al. "Enzymatic Properties of Cellulases from Humicola Insolens" Journal of Biotechnology (1997) 57: pp. 71-81.
Ozaki, Katsuya, et al. "Purification and Properties of an Acid Endo-1-4-B-Glucanase from *Bacillus* sp. KSM-330", Journal of General Microbiology (1991) 137: pp. 41-48.
Yi, Jing, et al. "Temporal and Spatial Distribution of Bacillus and Clostridium Histolyticum in Swine Manure Composting by Fluorescent in Siti Hybridization (FISH)", Applied Microbial Biotechnology (2012) 93: pp. 2625-2632.
Cutting, Simon M., et al. "Genetic Analysis" Molecular Biology Methods for Bacillus, John Wiley & Sons (1990) pp. 27-74.
Schaeffer, P., "Sporulation and the Production of Antibiotics, Exoenzymes, and Exotoxins" Bacteriological Reviews (1969) pp. 48-71.
Priest, Fergus G. "Systematics and Ecology of Bacillus", Department of Biological Sciences, Heriot Watt University, Scotland, pp. 3-16.
Khan, Feroz "New Microbial Proteases in Leather and Detergent Industries" Innovative Research in Chemistry (2013) 1:1, pp. 1-6.
Bai, Saraswati, et al. "Cellulase Production by Bacillus Subtilis Isolated from Cow Dung" Archives of Applied Science Research (2012) 4(1) pp. 269-279.
Kim, Yu-Kyoung, et al. "Isolation of Cellulolytic Bacillus Subtilis Strains from Agricultural Environments" ISRN Microbiology, vol. 2012, Article ID 650563, 9 pages.
Gautam, Richa, et al. "Optimization, Purification of Cellulase Produced from Bacillus *Subtilis* Subsp. Inaquosorum Under Solid State Fermentation and Its Potential Applications in Denim Industry" International Journal of Science and Research, (Jun. 2014) vol. 3, Issue 6, pp. 1759-1763.
Ng, Thomas, et al. "Comparison of Extracellular Cellulase Activities of Clostridium Thermocellum LQRI and Trichoderma Reesei QM9414" Applied and Environmental Microbiology, (1981) vol. 42, No. 2, pp. 231-240.
Ito, Susumu, et al. "Alkaline Cellulase for Laundry Detergents: Production by *Bacillus* sp. KSM-635 and Enzymatic Properties", Agric. Biol. Chem. (1989) 53(5), pp. 1275-1281.
Official Publication, Names and Definitions of Feed Ingredients, 9 pages.
Figure 5, Cell Architecture, 1 page.
Sneath, Peter H.A., "Endospore-Forming Gram-Positive Rods and Cocci" Bergey's manual of Systematic Bacteriology, (1986) Section 13, pp. 1104-1139.
Trautmann, Nancy, et al."Compost Microorganisms", Cornell Composting, Science and Engineering, www.compost.css.cornell.edu/microorg.html, (1996) 4 pages.
Coyne, Frederick Philip, et al. "On the Production of Mannitol From Hexoses and Pentoses by a White Species of Aspergillus" Studies in the Biochemistry of Micro-Organisms, From the Division of Biochemistry, London School of Hygiene and Tropical Medicine, University of London (1931), 9 pages.
Plaisance, G.P., et al. "The Mannitol-Producing Organisms in Silage" Journal of Bacteriology, (Dec. 27, 1920) VI, No. 5, pp. 431-443.
Branch, Solomon "Probiotics for Flatulence" LIVESTRONG Foundation, updated Jun. 28, 2015, 3 pages.
Shurson, Dr. Jerry, "Using Distiller's Grains in Livestock and Poultry Feeds" Department of Animal Science, University of Minnesota, 38 pages.
Yin, Li-Jung, et al. "Purification and Characterization of A Cellulase from Bacillus Subtilis YJ1" Journal of Marine Science and Technology (2010) vol. 18, No. 3, pp. 466-471.
Martin, Neal, et al. "Fiber Digestibility and Starch Content of Corn Silage" U.S. Dairy Forage Research Center, USDA, Idaho Alfalfa and Forage Conference, Feb. 26-27, 2008. Published Feb. 26, 2008.

BACTERIA AND ENZYMES PRODUCED THEREFROM AND METHODS OF USING SAME

REFERENCE TO RELATED APPLICATION

This application claims priority to previously filed provisional U.S. application Ser. No. 62/218,039, filed Sep. 14, 2015, the contents of which are incorporated by reference in its entirety.

SEQUENCE LISTING

The instant application contains a Sequence Listing which has been submitted electronically in ASCII format and is hereby incorporated by reference in its entirety. Said ASCII copy, created on Sep. 9, 2016, is named 290001-US_SL.txt and is 5,503,786 bytes in size.

BACKGROUND

Microorganisms which are capable of degrading cellulose are useful in multiple applications, but attempts to provide such microbials have met with limited success. Commercial production of cellulase enzymes which can degrade native vegetative cellulose is most successful using specific types of fungi. However, fungi do not lend themselves to use in products which supply viable enzyme producing-microbes. It is very problematic to harvest spores or propagules of fungi. This makes it more difficult to utilize viable cellulase producing fungi as a seed. The viability of such fungal "seeds" for viable conveyance of fungi is relatively sensitive to environmental conditions like heat, moisture, and desiccation. Bacteria have promise in such uses but applications can be limited due to requirements of specific narrow pH conditions and the like. Accordingly there is a need for new enzyme sources.

SUMMARY

Figure 1:
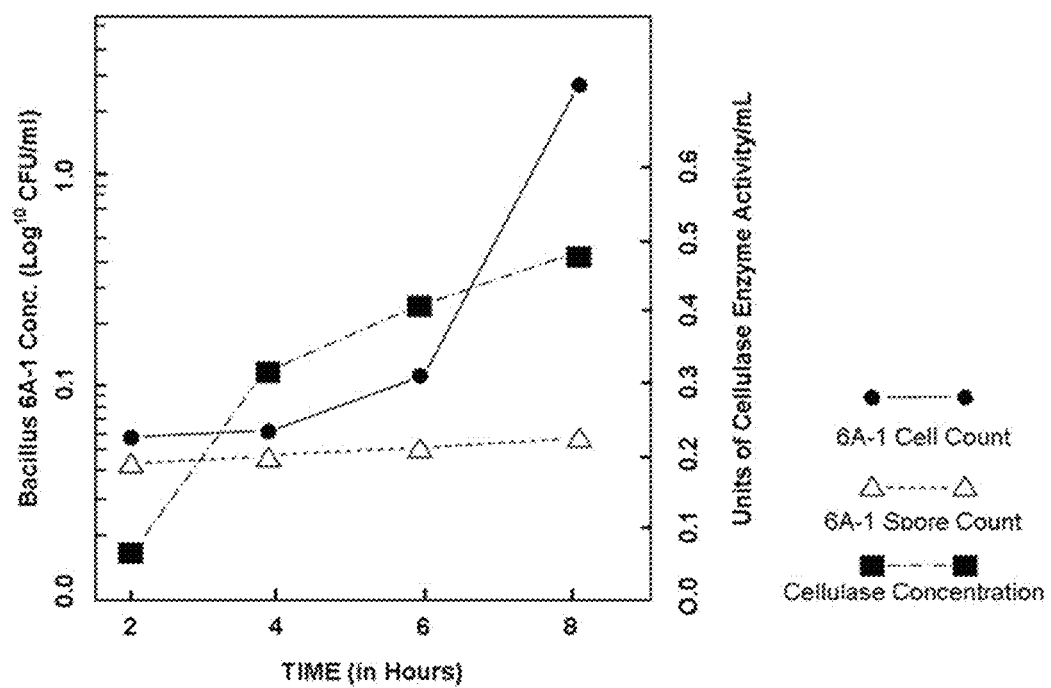
FIG. 1 is a graph showing cellulose production by *Bacillus subtilis* 6A-1. The straight line shows cell count of 6A-1, the dotted line shows spore count and the dashed and dot line shows cellulose concentration.

Described here is a bacterium which comprises the properties of a strain of *Bacillus subtilis* A-1, reference strain having been deposited as ATCC Deposition No. SD-6861. The *bacillus* composition including *Bacillus subtilis* 6A-1 or cells or spores may be used in various fields including, by way of example: ensilage, and the harvesting of feedstuffs, animal feed, as probiotics, ethanol production, waste treatment, and plant growth enhancement. The production of hydrolytic enzymes by *Bacillus subtilis* 6A-1 may be obtained by culturing in mesophilic conditions and in an embodiment using a liquid or semi-solid medium. The strain, spores, cells or extract may be dried, freeze dried, ground, filtered or combined with at least one excipient, carrier or diluent to product a polysaccharide degrading composition. Three enzymatically active protein fractions are produced by the strain and have shown to have activity on plant-produced native (unmodified) cellulose, microcrystalline cellulose and carboxymethyl cellulose. The strain also has protease activity. In an embodiment it is active in degrading the resistant and recalcitrant components of feedstuffs identified as acid detergent fiber (ADF). The strain retains such activity over a pH of 2 to 13. In a further embodiment the enzymes may be extracted, and may be use alone or in combination with the cells, spores or bacteria.

DESCRIPTION

Disclosed here is a unique strain of *bacillus* identified as *Bacillus subtilis* 6A-1 and methods of using same. The strain is capable of degrading polysaccharides. The strain produces three distinct enzymatically active protein fractions which are capable of degrading cellulose. These active protein fractions are separable by polyacrylamide gel electrophoresis. The bacterium can degrade polysaccharides including cellulose and in an embodiment can degrade unmodified, plant-produced cellulose in addition to modified cellulose and microcrystalline cellulose.

A modified cellulose that can be degraded is carboxymethyl cellulose referred to as CMC. Cellulose in the form of CMC readily forms a viscous, colloidal suspension in water, in contrast to crystalline cellulose, and the carboxymethyl groups of CMC are bound to hydroxyl groups of glucopyranose monomers. It is used in food and dairy applications for thickening, water retention and dispersion and chemical stability, for example. It is often used as its sodium salt: sodium carboxymethyl cellulose. The capacity to degrade carboxymethyl cellulose, crystalline cellulose, and cellulose in its natural state is surprising.

Further, it can degrade particularly recalcitrant forms of Acid Detergent Fiber (ADF). This is the least digestible portion of edible parts of the non-grain portion of plants and is what remains after boiling a forage sample in acidic detergent. Components include lignin, cellulose, and insoluble nitrogen and do not include hemicellulose. Methods of measuring ADF are known, such as Van Soest and Wine (1968) "Determination of lignin and cellulose in acid-detergent fiber with permanganate" *J. Assoc. Offic. Anal. Chem.* (AOAC) 51(4) 780-785. (All references cited herein are incorporated herein by reference).

Further, *Bacillus subtilis* 6A-1 can degrade cellulose at a wide range of pH, from pH2 to pH13. The *bacillus* excretes enzymes in extracellular manner which provides for separation and harvesting of these extracellular enzymes where desired. Alternatively, the *bacillus* cells or spores produced by the organism, both cells and spores or a combination of cells and spores and extracted enzymes may be combined for use in various applications. It is shown non-starch polysaccharides are degraded by enzymes produced by the *bacillus*. When used to break down carbohydrates of feed for animals, the result is a more efficient feed conversion providing higher digestible sugar availability and less complex sugars.

*Bacillus subtilis* 6A-1 can be grown in liquid or semi-solid medium, is a mesophile, meaning that the strain has activity, grows, divides, multiplies, and metabolizes best at temperatures below 55° C. These values are not always absolute, but data indicates that 6A-1 does not grow well at temperature 55° C. and above, and certainly it would not be practical to grow the *bacillus* at or above that temperature, and the bacterium can grow and divides in a range of 20° C. to 50° C. with a preferred range of growth at 30° C. to 35° C. These properties provide that *Bacillus subtilis* 6A-1 is useful in a wide range of processes.

*Bacillus subtilis* 6A-1 multiplies and is easily produced in aerobic culture, but is also able to grow under moderately reduced oxygen conditions, often described as being microaerophilic in nature. (Determined by procedure utilizing Brain Heart Infusion Agar (BHIA (L007442) and BD GasPak® systems using BD BBL™ CampyPak™ Plus Microaerophilic System Envelopes with Palladium Catalyst (8801241) for determination. BD Becton, Dickinson and Company Sparks, Md. 21152 US.)

Activity across a broad pH range provides it can be used in many processes which have considerably different pH range requirements, and in processes requiring different pH ranges at different points of the process. The *Bacillus subtilis* 6A-1 may be employed in ensilage fermentation which requires a neutral to alkaline pH at initiation and acidic pH upon completion, as discussed below. When used in feed, the pH may vary from alkaline to acidic throughout the processes of ingestion and digestion. By way of example without limitation, it is useful in processes utilizing degradation of cellulose of plant matter, in ensilage, as an additive to animal or human feed, in waste remediation, and production of biogas. Reference culture of the strain has been deposited with the American Type Culture Collection, ATCC No. SD-6861. A deposit of describe the microorganism is and has been with the American Type Culture Collection (ATCC) Rockville, Md. 20852 USA, ATCC Deposit No SD-6861 The deposit will be maintained in the ATCC depository, which is a public depository, for a period of 30 years or five years after the most recent request, or for the effective life of the patent, whichever is longer, and will be replaced if it becomes nonviable during that period. Additionally, Applicant has satisfied all the requirements of 37 C.F.R. §§ 1.801-1.809, including providing an indication of the viability of the sample. Applicant imposes no restrictions on the availability of the deposited material from the ATCC after issuance of the patent; however, Applicant has no authority to waive any restrictions imposed by law on the transfer of biological material or its transportation in commerce. Applicant does not waive any rights it may have under this patent or any related protection available.

Other enzymes produced by the method described catalyze the degradation of other plant gums and recalcitrant beta-glucans including the beta-linked glucan-polysaccharides of the types represented by lichenin, laminarin, oat spelt, barley and other naturally occurring forages, grasses, and vegetative materials such as wheat straw and corn stover.

As noted the bacteria itself may be used, or the cells or spores or the enzymes it produces. Further, *Bacillus subtilis* 6A-1 also includes asporgenous mutants, that is, bacteria that does not produce spores. Asporogenous mutants of *bacillus* species are well documented (Schaeffer, P. 1969 Sporulation and the Production of Antibiotics, Exoenzymes, and Exotoxins, *Bacteriol. Rev.* 33:48-71). Early-blocked asporogenous mutants will produce less protease and thus increase the amount of cellulolytic enzymes that can be harvested from the mutant of *Bacillus subtilis* 6A-1. Such a mutant strain would be able to produce *Bacillus subtilis* 6A-1 exoenzymes and not produce spores, enabling the separate production of enzymes and spores. The process of induction and isolation of *Bacillus subtilis* 6A-1 may in one embodiment be carried out according to the procedure in Cutting, S. M. and Vander Horn, P. B. (Cutting, S. M. and Vander Horn, P. B. Chapter 2 Genetic Analysis in Molecular Biology Methods for *Bacillus*. Ed Harwood, C. R. and Cutting, S. M. 1990 John Wiley & Sons) presented here by way of example without limitation. A culture of the bacteria is grown in a rich nutrient media at 30° to 39° C. with vigorous aeration until optical density reaches 0.7-1.0. It is then subjected to a mutagen such as ultraviolet light, ethyl methanesulfonate or N-methyl-N-nitro-N-guanidine, nitrous acid and o-methylhydroxylamine. Cells are washed by pelleting the cells by centrifugation and resuspending them in 0.01M phosphate buffered saline twice. An example of a protocol that may be used is as follows. Washed cells are used to inoculate sterile rich nutrient media and grow up overnight at 30° to 39° C. with vigorous aeration. The culture is streaked on sporulating medium agar plates (ie Arret Kirshbaum or Nutrient Sporulating) and incubate overnight at 30° to 39° C. Isolated transparent colonies (opaque and tan colonies are producing spores and can be eliminated from consideration) are picked and used to inoculate a rich nutrient media and incubate overnight at 30° to 39° C. with vigorous aeration. One ml of culture is exposed to 80° C. for one hour then plated on rich media agar plates and incubate overnight at 30° to 39° C. Cultures that are able to grow after heat exposure are not asporgenous and discarded. Remaining cultures are assayed to enzyme production.

Bacilli of various types may be produced and preserved in the following manner presented here by way of example without limitation. The bacteria may be cultivated in either liquid or semi-solid fermentations. In the case of liquid fermentations, viable bacterial cells and spores may be separated and concentrated by filtration of several types including tangential flow filtration and ultrafiltration, or centrifugation, The viable bacterial cells and/or spores may be stabilized by drying or by introduction of stabilizing substances such as propylene glycol, sodium chloride, or other materials that are not toxic to the bacteria but bring about a biostatic state. They also may be subjected to freezing in presence of cryoprotective substances. Drying or desiccation of cells or spores may be accomplished by spray drying, freeze drying, or the introduction of carriers followed by air drying in mobile or static layers or other specialized processes such as fluidized bed drying.

Enzymes produced in liquid fermentation remain in liquid state during downstream processing steps outlined above. The steps above remove the enzyme-producing bacterial cells and/or spores from the liquid. Enzymes in one embodiment may be further concentrated by reverse osmosis or ultrafiltration or they may be precipitated with salts such as ammonium sulfate, the addition of alcohols and nonaqueous solvents, or by other precipitating means. The resultant enzymes, concentrated or unconcentrated, may be dried by spray drying or other methods outlined above, or they may be stabilized in liquid state by the addition of sodium chloride, sucrose, propylene glycol, organic acids, or other biostatic additions which render the enzyme suspension stable and resistant to spoilage.

Enzymes produced via semi-solid fermentation (sometimes called "solid state fermentation" or "koji process") may be extracted by aqueous or non-aqueous solvents and further purified by filtration, centrifugation and concentrated and/or stabilized by the methods taught above. Alternately, enzymes and bacterial cells and spores may be dried together in unseparated state by processes such as simple air drying or fluidized bed drying which preserves both enzyme activity and bacterial cell and spore viability.

The bacteria, spores, cells and/or enzyme products may be further subjected to treating by drying, freezing or filtering as discussed herein or grinding, standardization, or extension with carriers and extenders including, but not limited to: ground limestone and calcium carbonate, sodium chloride, sodium bentonite, zeolites, or other nontoxic mineral compounds or with vegetable or grain or organic products or byproducts such as maltodextrin, dextrose, dried molasses, corn meal or other products, wheat middlings or other products, or even various distillers' by products.

The bacteria, cells, spores or enzymes in an embodiment are combined with a carrier, excipient and/or diluent appropriate for the process in which it will be used. Where administered to an animal, it will be non-toxic to the animal. The carrier, excipient and/or diluent is provided to provide improved properties of the composition, such as standardizing, preserving and stabilizing, allowing the bacteria or component to survived the digestive system of an animal, lubrication, and improve delivery. There are a myriad of such agents available which may be added. Without intending to be limiting, examples include wetting agents and lubricating agents, preservative agents, lipids, stabilizers, solubilizers and emulsifiers such as examples provided below.

Examples of Standardization of the Enzyme Product (Diluent):

Processed Grain By-Products (e.g. brewers dried grains, corn meal, corn gluten meal, ground corn, corn cob fractions, distillers dried grains or solubles, peanut skins, wheat bran, rice bran, rye middlings, wheat middlings and grain sorghum mill feed).

Roughage Products (e.g. ground straw, dried citrus meal, dried beet pulp, almond hulls cottonseed hulls, oat hulls, ground corn cobs, peanut hulls and rice hulls)

Forage Products (e.g. alfalfa leaf meal, ground alfalfa or coastal Bermuda grass hay, ground grass and dehydrated silage).

Molasses Products (e.g. beet, cane or citrus molasses).

Plant Protein Products (e.g. beans, cottonseed meal, peas, soybeans, sunflower meal)

Mineral Products (e.g. calcium carbonate, magnesium mica, diatomaceous earth, bentonites, Zeolites, mineral salts)

Carbohydrate Products (e.g. maltodextrin, starch, cellulose, dextrose, fructose, sucrose, polydextrose, saccharin, powdered or granulated sugar, maltose, sugar alcohols)

Milk and whey products (e.g. dried whey, dried wheyproduct, lactose, dried skimmed milk, dried milk protein, casein, sodium caseinate.

Anti-caking (flow) agents for the enzyme product examples include without limitation: tricalcium phosphate, powdered cellulose, magnesium stearate, sodium bicarbonate, sodium ferrocyanide, potassium ferrocyanide, calcium ferrocyanide, bone phosphate, sodium silicate, silicon dioxide, calcium silicate, magnesium trisilicate, talcum powder, sodium aluminosilicate, potassium aluminium silicate, calcium aluminosilicate, bentonite, aluminum silicate, stearic acid, polydimethylsiloxane.

Examples of preservatives include without limitation sodium chloride, potassium sorbate, calcium or sodium propionate, boric or boronic acid as well as all those "Chemical Preservatives" listed in Section 18 of the *Official Publication* of the Association of American Feed Control Officials, Inc. Champaign, Ill. (2015, 2016).

Emulsifiers and surfactants include without limitation polysorbates (40,60,80), acetylated monoglycerides, monooleates, polyglyceryl fatty acids, e.g. Polyglyceryl-3 Stearate, Polyglyceryl-3 Palmitate, Polyglyceryl-5 Laurate, Polyglyceryl-5; Oleates, Polyglyceryl-10 Diisostearate, Polyglyceryl-3 Polyricinoleate, Glyceryl Oleate, additional polyglyceryl compounds, e.g. Polyglyceryl-6 Caprylate, Polyglyceryl-10 Laurate.

The following is provided as examples of processes in which the strain and products produced may be used without intending to be limiting.

Silage and Animal Feed

Digestion of cellulosic fiber and vegetable gum-type polysaccharides (non-starch polysaccharides—NSPs) represent continuing challenges in various industries. NSPs represent the primary class of incompletely digested feedstuff components in the area of animal feeding. NSPs may also represent anti-nutritional challenges in the practice of animal feeding. These compounds result in changes in intestinal mobility and lower efficiency of production. Even though ruminant-type animals can digest much fiber, the more resistant NSPs and poor quality fiber represent appreciable challenges to complete digestion and most efficient use of feedstuffs. In addition to harvested crops, naturally high in fiber and less digestible, there are great quantities of byproducts of fuel ethanol production and other fibrous products which find their way into animal feeds. These byproducts contain difficult-to-digest substances, but represent potentially valuable feedstuffs if they can be digested and assimilated by animals (See Shurson, J. "Using Distiller's Grains By-products in Livestock and Poultry Feeds," University of MN world widewebbiofuelscoproducts.umn.edu/sites/bio-dieselfeeds.cfans.umn.edu/files/cfans asset 413198.pdf). Distiller's Dried Grains (DDG's) are the dried residue remaining after the starch fraction of corn is fermented with selected yeasts and enzymes to produce ethanol and carbon dioxide. After complete fermentation, the alcohol is removed by distillation and the remaining fermentation residues are produced including wet distiller's grains, condensed distillers solubles, and modified wet distillers grains, which are fed to ruminants, or the condensed distiller's solubles is combined with the wet distiller's grains fraction and dried to produce DDGS. Of all of these co-products, DDGS is the predominant form produced and available to the global feed industry (Shurson, J). Similar grain byproducts are available from the brewing of beer or ales of various types.

Successful ensiling processes depend upon a significant level of fermentable sugar that can be converted to organic acid. Ensiled crops such as legumes, small grains, and various temperate and tropical grasses have relatively high fiber and NSP content and may contain little fermentable sugars. The fermentable sugars are converted to volatile and non-volatile fatty acids by organic acid-producing bacteria. These bacteria require relatively simple sugars. The fatty acids that the aforementioned bacteria produce reduce the overall pH of the ensiled material and preserve it for use as needed. It is essential for preservation that ensiled materials contain a sufficient level of fermentable sugars so that a reasonable preservation rate may be attained. Poorly digestible fiber very often deleteriously affects silage preservation and its feeding quality. (See Martin, et al—Neal Martin, David Mertens, and Mary Beth Hall, "Fiber Digestibility and Starch Content of Corn Silage," U.S. Dairy Forage Research Center, USDA-ARS, 1925 Linden Dr. West, Madison, Wis. 53706, Joe Lauer, U of Wisconsin-Madison. Idaho Alfalfa and Forage Conference, 26-27 Feb. 2008.)

Purified enzymes (like cellulases and other beta-glucanases) have been applied to silage to improve the ensiling process and to livestock and poultry feeds to enable animals to render better feed efficiency from available diets. These enzymes, while they may be cost effective, may also be relatively expensive, are heat labile, and may not have optimal activity in the pH range of the specific feed application. Enzymes also do not reproduce and multiply their effects. Once degraded or denatured, their activity is lost.

Bacteria can be used as components of preparations which contain viable microorganisms which are then fed to animals. Bacteria are fed to many diverse animal species including many species of mammals, avian species, crustaceans and fish. Specific supplements and fermented foods contain bacteria which are consumed by humans. The viable microbial preparations that are fed to animals and humans are known as Probiotics or Direct Fed Microbials (DFMs). They are fed to the aforementioned animal species for such broad ranging effects as increasing feed conversion for more efficient production of milk, of animal protein, eggs, etc. They are also associated with increased resistance to intestinal counter-productive microorganisms and pathogens. They are said to increase positive effects from enzyme production in the gut. In ruminant species particularly, there are other positive effects which have been noted: increased fatty acid production, which often translates into more butterfat in milk; suppression of pathogenic bacteria in the rumen and gut which translates into reduced deleterious microbial load at point of slaughter; increased levels of bypass protein; decreased acidosis, etc.

The attempt to provide cellulase-producing DFMs or viable microbial seed products to the various processes and industries that could utilize the catalytic action of such microbes has had limited success.

DFMs and Probiotics are fed to help minimize negative digestive effects of ingesting feed or foodstuffs that are relatively hard for the animal or human to digest. An often-claimed result of ingesting feedstuffs or foods with indigestible fiber and NSPs are flatulence and other serious anti-nutritional effects (See "Probiotics for Flatulence" http://world wide web.livestrong.com/article/274832-probiotics-for-flatulence/; http://world wide web.globalhealingcenter.com/natural-health/3-ways-to-reduce-and-neutralize-flatulence/Flatulence in dogs: "Dietary causes are the main source of flatulence in dogs. Low-quality foods with ingredients that can't be fully digested can cause gas": at pets.webmd.com/dogs/flatulence-dogs) which is reduced by in ingestion of the compositions described here.

Current supported uses in feed by AAFCO/FDA include NSP-digesting enzymes like those which can hydrolyze xylans, hemicelluloses and beta-glucans. These enzymes are recognized for their effects in reducing "sticky droppings," reducing the viscosity of digesta, and assisting with other anti-nutritional effects in animals (AFCO *Official Publication*).

Septic Tank Application for Bacteria and Enzymes

Enzymes and bacteria are commonly added to septic tanks and other types of waste treatment systems such as cesspools, lagoons, drip systems, composting toilets, sewage systems, wet wells, and camp toilets. These viable bacteria and active enzymes are added in order to more effectively degrade waste and digest solid materials. Some of the most problematic classes of compounds to digest are cellulose, natural fiber, and NSPs. Purified cellulase enzymes may be added to such systems. However, the discovery of bacteria which can produce fiber-digesting enzymes and which can be produced in stable preparations has proven problematic Composting Composting is primarily an aerobic degradative process which helps to stabilize and reduce solid waste, rendering it stable, and producing an organic product which can be used as a mulch, bedding, soil conditioning, or organically-based fertilizing material. The organic waste commonly subjected to the composting process includes paper waste, lignocellulosic materials from agricultural crop production or industrial processes, and solid waste from animals (often confined and concentrated) and additionally from human sewage solids. The moist, undried waste material is piled in heaps or long piles called windrows. The material is turned and mixed regularly, generally with the aid of some type of mechanical equipment to reaerate the piles and to re-expose waste substrates to the multiplying and metabolizing microorganisms residing therein. The greatest portion of this waste is comprised of fiber containing cellulose-based materials. One of the primary purposes of composting is reduce the volume of the waste. Increased cellulosic digestion increases the rate of reduction. The initial stages of composting are considered mesophilic and the primary microbial populations at the stage are said to be bacilli (Trautmann and Olynciw, Yi et al. "Compost Microorganisms" http://compost.css.cornell.edu/microorg.html). The addition of bacteria-containing products is used to accelerate the initial composting activity and sometimes to affect the quality of the end product.

BioGas Production

BioGas is gaseous fuel, especially methane and in some cases, carbon monoxide and hydrogen, produced by the fermentation of organic matter. It includes any gas fuel derived from the decay of organic matter, as the mixture of methane and carbon dioxide produced by the bacterial decomposition of sewage, manure, garbage, or plant crops. Biogas production is a technology which is utilized in various parts of the world, including the US, to digest waste under (primarily) anaerobic conditions and in so doing create appreciable quantities of methane gas which can be used as a fuel source. The efficient production of methane and high energy gas from biological processes requires efficient digestive steps. The initial digestion step depends upon efficient breakdown of fibrous material including the digestion of cellulose and NSPs to alternative substrates with lower molecular weight. The methanogens (bacteria that produce methane) can readily absorb and metabolize these materials with low molecular weight.

It has been stated that the rate limiting step to methanogenesis is the effective degradation of complex polysaccharides such as cellulose and other NSP's into simpler, lower molecular weight compounds. The rate limiting step in methanogenesis (biogas production) is in the first hydrolytic stage of substrate breakdown. The hydrolytic process and the bacteria associated with it (like 6A-1) enzymatically reduce large molecules (like cellulose) to small ones, upon which the biogas process feeds. The following article states that " . . . the hydrolysis of cellulose was so low that this was shown to be the rate-limiting step in overall anaerobic digestion." See Noike et al. (1985) "Characteristics of carbohydrate degradation and the rate-limiting step in anaerobic digestion." *Biotechnol. Bioeng.* 27(10):1482-9; Mahmood et al. (2006) "The rate-limiting step in anaerobic digestion in the presence of phosphine." *Toxicology and Industrial Health* 22(4):165-72. Das Neves, et al. teaches that biogas production can be positively affected by *Bacillus subtilis* and other bacilli-application. Das Neves, Luiz Carlos Martins, et al. "Biogas production by *Bacillus* sp. anaerobic cultivations: new trend of alternative energy source in urbanized areas." Poster presentation. U.S. Department of Energy and Society for Industrial Microbiology special conference "30$^{th}$ Symposium on Biotechnology for Fuels and Chemicals. New Orleans, La. May, 2008.

By way of example, biogas can be formed by transformation of organic material such as plants, most typically crop residue, food and also farm waste such as animal manure, and can even be used to convert human waste to energy. In this instance the bacteria strain or spore or cells or enzyme fraction or all or any of these entities in combination is placed in contact with the organic material or cellulose composition under anaerobic conditions to produce biogas which may include methane, carbon dioxide, nitrogen and possibly also hydrogen sulfide, carbon monoxide and water vapor.

Data on *Bacillus subtilis* 6A-1 indicates that it can grow under conditions of low oxygen content (or microaerophillic conditions). See the methodology and information regarding growing conditions discussed above. Since *bacillus* spores are dormant as far as metabolism is concerned, and very resistant to anaerobic conditions, they can be grown aerobically, or semi aerobically and are well known to be still quite stable, that is retain their potential viability, under anaerobic conditions once they are in spore state. Production of enzymes by *Bacillus subtilis* 6A-1 does not require an aerobic or anaerobic environment. See Sonenshein, et. al. *Bacillus subtilis and Its Closest Relatives from Genes to Cells*. ASM Press, 2002. p. 30 for the lifecycle of *Bacillus subtilis* showing the vegetative cell/spore cycle development.

Furthermore, Barbara Setlow and Peter Setlow "Heat Killing of *Bacillus subtilis* Spores in Water Is Not Due to Oxidative Damage" in *Appl. Environ. Microbiol.* October 1998 vol. 64 no. 10. 4109-4112 state "The heat resistance of wild-type spores of *Bacillus subtilis* or spores (termed α$^-$ β−) lacking DNA protective α/β-type small, acid-soluble spore proteins was not altered by anaerobiosis"

The biogas so produced may be collected by any various methods, and can be subject to further purification or commercial processes. Numerous treatments are available for increasing the volume and efficiency of biogas, some by bacteria addition and some via enzyme addition, the enzymes used are notably cellulase and other NSP digesting catalysts. Without intending to be limiting, such processes available include those described at U.S. Pat. No. 8,828,124 and U.S. Pat. No. 9,040,271 incorporated herein by reference.

Agriculture/Bioag Use

Mixtures of microorganisms are applied to seeds of crops and introduced directly into the soil for the purpose of stimulating and enhancing the growth of crops. Crops can benefit from the introduction of degradative microorganisms into the root zone; those microbes can degrade complex compounds and mineral-binding polymers. The release of nutrients in the root zone results in greater growth and production rates by key crops and other plants. The microbially enhanced biochemical process also results in conservation of key nutrients and prevents the need for over fertilization. Naturally occurring *Bacillus* spp. are considered to be allowable for (certified) organic food production by the U.S. NOP (National Organic Program).

As early as 1993, it was stated that it was beginning to become clear that the well-recognized association of bacilli with roots and seeds might not be just a chance association, and early strategies developed toward the use of bacterial inoculants to improve plant performance. (F. G. Priest, "Systematics and Ecology of *Bacillus*," in Sonenshein et. al. *Bacillus subtilis and other gram positive bacteria*, ASM Press, 1993. p. 12) Furthermore, *Bacillus* species—or other closely related bacterial-strains and genera are desirable for use in food crops, and in agriculture. The use of *Bacillus subtilis* and many more similar strains of bacilli are desirable since those chosen species of bacteria are considered safe, effective, stable and are relatively inexpensive to produce.

Bacilli such as *Bacillus subtilis, Bacillus licheniformis, Lysinibacillus* spp. and *Paenibacillus* spp, are used in some microbial/fertilizer or plant application products for the purpose of enhancing plant food's effects. Some strains are used as registered pesticides and as antagonists to reduce the incidence of (primarily) harmful fungi which attack the seeds or plants.

Detergent or Cleaning Application

Commercially available cellulases for cleaning are generally of the exo-acting cellulase type which catalyze the hydrolysis of crystalline or "native" cellulose, like fibers from cotton. Cellulase enzymes for these applications have been traditionally derived from fungi. Fungal strains include *Trichoderma longibrachiatum/viride/reesei, Aspergillus niger/aculeatus,* and *Humicola insolens. Humicola insolens* genes are cloned into production strains of *A. oryzae* or *A. niger* for practical production of the alkaliphilic *H. insolens'* cellulase. Cellulose-digesting enzymes suitable for detergent and other commercial applications have been more difficult to find in bacteria.

Commercial cellulases are useful in biopolishing of newly manufactured textiles, for providing an abraded or worn look of cellulosic fabric (which term includes cloth, textiles or garment)—especially denim (often called "stone washing"). Suitability for most detergent applications requires that a cellulase be active in the alkaline range, pH 10.0-12.0. Enzymatic cleaning and detergent care use is also discussed at, for example, Lilley et al., "Care Enzymes System" WO 2013167613 A1 incorporated herein by reference. Cellulase may be used for (1) the surface cleaning of microfibrils and micro-pills which occur on cotton or other cellulose-based fabrics and (2) the softening and decolorization of denim material, particularly providing a pre-washed, softened, or pre-worn appearance to denim jeans, including certain cellulases in presoaks or detergents can reduce and remove microfibrils/micro-pills and fray and surface balling on the fabric and enhance the appearance of cotton goods. In still another example, the use of cellulase preparations with or without stones or other physical abrasion additives accelerate the softening and pre-worn look and feel of denim goods. Even further examples relate to textile enzymes to improve production methods and fabric finishing, such as using amylases to remove starch size, cleaning fabric to remove waxes, hemicelluloses and other impurities, removing pectin, or even use with or without stones to achieve a desired appearance of the fabric. Enzymes are useful for a variety of processes to modify fabrics. For examples, see world wide web.novozymes.com/en/about-us/brochures/Documents/Enzymes_at_work.pdf.

The myriad of other potential applications to which the bacterial and cells or spores or enzymes may be used include, by way of example without limitation, deinking and modification of forest products, particularly paper products and use of xylanases (which *Bacillus subtilis* 6A-1 produces) in bleaching paper, with reduction of the use of harsh chemicals.

These are but a few examples use of the 6A-1 enzymes in a composition for conditioning or modifying fabric, where the enzymes are used in a process in which a property of the fabric such as color, texture, wettability or the like is different after application of the enzyme.

Regardless of the specific application, cellulose in fibrous or crystalline form is difficult to digest enzymatically. Although this crystalline cellulose is a beta-glucan by definition, commonly available beta-1,4-glucanases are not effective in hydrolyzing crystalline cellulose. The beta-1,4 glucanases commonly produce by bacilli are more effective against modified cellulose, such as caboxymethylcellulose (CMC), and other beta-glucans (gums) from vegetative origin.

The term plant or plant material or plant part is used broadly herein to include any plant at any stage of development, or to part of a plant, including a plant cutting, a plant cell, a plant cell culture, a plant organ, a plant seed, and a plantlet. A plant cell is the structural and physiological unit of the plant, comprising a protoplast and a cell wall. A plant cell can be in the form of an isolated single cell or aggregate of cells such as a friable callus, or a cultured cell, or can be part of a higher organized unit, for example, a plant tissue, plant organ, or plant. Thus, a plant cell can be a protoplast, a gamete producing cell, or a cell or collection of cells that can regenerate into a whole plant. As such, a seed, which comprises multiple plant cells and is capable of regenerating into a whole plant, is considered a plant cell for purposes of this disclosure. A plant tissue or plant organ can be a seed, protoplast, callus, or any other groups of plant cells that is organized into a structural or functional unit. Particularly useful parts of a plant include harvestable parts and parts useful for propagation of progeny plants. A harvestable part of a plant can be any useful part of a plant, for example, flowers, pollen, seedlings, tubers, leaves, stems, fruit, seeds, roots, and the like. A part of a plant useful for propagation includes, for example, seeds, fruits, cuttings, seedlings, tubers, rootstocks, and the like. Any plant in which it is desired to break down cellulose may be used in the processes here. By a "crop plant" is intended any plant that is cultivated for the purpose of producing plant material that is sought after by man for either oral consumption, or for utilization in an industrial, pharmaceutical, or commercial process. The compositions may be applied to any of a variety of plants, including, but not limited to maize, wheat, rice, barley, soybean, cotton, sorghum, beans in general, rape/canola, alfalfa, flax, sunflower, safflower, millet, rye, sugarcane, sugar beet, cocoa, tea, *Brassica*, cotton, coffee, sweet potato, flax, peanut, clover; vegetables such as lettuce, tomato, cucurbits, cassava, potato, carrot, radish, pea, lentils, cabbage, cauliflower, broccoli, Brussels sprouts, peppers, and pineapple; tree fruits such as citrus, apples, pears, peaches, apricots, walnuts, avocado, banana, and coconut; and flowers such as orchids, carnations and roses.

In referring to a "cellulose-degrading enzyme" is intended an enzyme, including but not limited to cellulases and other glucosidases that can be utilized to catalyze the hydrolysis of or promote the degradation of cellulose into sugar monomers or cellodextrins or smaller molecular weight parts of which the cellulose is composed.

The International Union of Biochemistry (I.U.B.) Hydrolase Enzyme Classification 3.2.1.x includes cellulose degrading enzymes. Listed below, by way of example without intending to be limiting, are several of these I.U.B. classified cellulases.

EC 3.2.1.4 cellulase
EC 3.2.1.6 endo-1,3(4)-β-glucanase
EC 3.2.1.21 β-glucosidase
EC 3.2.1.39 glucan endo-1,3-β-D-glucosidase
EC 3.2.1.58 glucan 1,3-β-glucosidase
EC 3.2.1.91 cellulose 1,4-β-cellobiosidase
EC 3.2.1.136 glucuronoarabinoxylan endo-1,4-β-xylanase
EC 3.2.1.156 oligosaccharide reducing-end xylanase For the degradation of cellulose, for example, two general types of cellulase enzymes can be employed. Cellulase enzymes which cleave the cellulose chain internally are referred to as endo-β-1,4-glucanases (E.C. 3.2.1.4) and serve to provide new reducing and non-reducing chain termini on which exo-β-1,4-glucanases (cellobiohydrolase, CBH; E.C. 3.2.1.91) can operate (Tomme et al. (1995) Cellulose hydrolysis by bacteria and fungi, *Advances in Microbial Physiology* 37:1-81). Two types of exoglucanase have been described that differ in their approach to the cellulose chain. One type attacks the non-reducing end and the other attacks the reducing end. The product of the exoglucanase reaction is typically cellobiose, so a third activity, β-D-glucosidase (E.C. 3.2.1.21), is required to cleave cellobiose to glucose. The exoglucanase can also yield longer glucose chains (up to 6 glucose units) that will require a β-D-glucosidase activity to reduce their size. Relative to the other enzyme activities needed for degradation of cellulose into fermentable sugars, only a minor amount of the β-D-glucosidase activity is required.

The method and compositions described are useful in animals including, but not limited to, humans, canine (e.g., dogs), feline (e.g., cats); equine (e.g., horses), bovine (e.g., cattle), ovine (e.g. sheep), caprine (e.g. goat) porcine animals (e.g., pigs) and rabbit, as well as in avians including, but not limited to, chickens, turkeys, ducks, geese, a quail, a pheasant, parrots, finches, hawks, crows and ratites (ostrich, emu, cassowary, and the like as well as domestic fur animals such as ferrets, minks, mustilids, and fish such as fin-fish, shellfish, and other aquatic animals. Fin-fish include all vertebrate fish, which may be bony or cartilaginous fish. Further examples of fin-fish include salmonid fish, including salmon and trout species, such as coho salmon (*Oncorhynchus kisutch*), brook trout (*Salvelinus fontinalis*), brown trout (*Salmo trutta*), chinook salmon (*Oncorhynchus tshawytscha*), masu salmon (*Oncorhyncus masou*), pink salmon (*Oncorhynchus gorbuscha*), rainbow trout (*Oncorhynchus mykiss*), Arctic charr (*Salvelinus alpinus*) and Atlantic salmon (*Salmo salar*). However, any other fish species may benefit, such as ornamental fish species, koi, goldfish, carp, catfish, yellowtail, sea bream, sea bass, pike, halibut, haddock, tilapia, turbot, wolffish, and so on. Examples of shellfish include, but are not limited to clams, lobster, shrimp, crab and oysters. Other cultured aquatic animals include, but are not limited to eels, squid and octopi. Still further examples include, crustacean (e.g. lobsters, crabs, shrimp, crayfish), mollusks (e.g., squid, clams, octopus, snails, abalone, mussels), Porifera (sponges), Cnidaria (e.g., jellyfish, sea anemones), Ctenophora, Echinodermata and aquatic worms.

The compositions and processes may be particularly useful with ruminant animals. As used here, the term "ruminant" means an even-toed hoofed animal which has a complex 3- or 4-chamber stomach and which typically rechews what it has previously swallowed. Some non-exhaustive examples of ruminants include cattle, sheep, goats, oxen, musk oxen, llamas, alpacas, guanacos, deer, bison, antelopes, camels, and giraffes.

The bacterial cells, spores or enzymes in an embodiment are combined with a carrier, excipient and/or diluent appropriate for the process in which it will be used, as described above. Where administered to an animal, it will be non-toxic to the animal. There are a myriad of such agents available which may be added. Without intending to be limiting, examples include standardizing agents, extenders, wetting agents and lubricating agents, preservative agents, lipids, stabilizers, solubilizers, free flowing agents, and emulsifiers.

Examples that may be particularly useful in administration to an animal include ground corn cobs, salt, ground limestone, calcium carbonate, sodium bentonite, zeolites, ground soy hulls, citrus pulp, dairy byproducts, animal protein products, grain products, plant protein products, processed grain products and by-products, roughage products, molasses products fermentation byproducts such as dried distillers grains and/or solubles, citric acid and glutamic acid fermentation byproducts and the like.

*Bacillus subtilis* 6A-1 produces proteases capable of degrading proteins across a wide range pH, from pH 2 to pH 12. The proteases are excreted in extracellular manner which provides for separation and harvesting of these extracellular proteases where desired. Proteases from *Bacillus subtilis* 6A-1 have many possible applications. Addition of proteases to silage and animal feed yields greater feed efficiencies by rendering the feed more easily absorbed by livestock. Detergents both domestic and industrial have long contained proteases that aid in the removal of proteineous materials. *Bacillus subtilis* 6A-1 protease is able to breakdown keratin a major component of hair and feathers, making it useful for poultry waste treatment and dehairing of hides to prepare leather (See Kahn, F. 2013 "New Microbial Proteases in Leather and Detergent Industries" *Innov. Res. Chem.* 1(1): 1-6). Use of proteases in leathering processes eliminate some of the toxic chemicals and allow for the simple degradation of unwanted proteins in an eco-friendly method. Addition of proteases to fermentation vats has been shown to increase fermentation rates and ethanol production (See Johnston, D. and McAlbon, A. 2014 "Protease Increases Fermentation Rate and Ethanol Yield in Dry Grind Ethanol Production" *Bioresource Technology* 154:18-25).

References referred to herein are incorporated herein by reference. The following examples are provided for the purpose of exemplification and are not intended to be limiting.

EXAMPLES

Example 1

Determination of *Bacillus Subtilis* 6A-1 Identity

Biochemical and phenotypic characterization of *Bacillus subtilis* 6A-1 was performed using API 20 E identification test strips (BioMerieux 20 100) and API 50 CH 50 carbohydrate fermentation test strips (BioMerieux 50 300). The resulting biochemical profile of *Bacillus subtilis* 6A-1 was 94% similar to that of *Bacillus subtilis*.

Confirmation of this classification was performed through genomic sequencing. DNA was extracted (Fast DNA stool mini kit Qiagen) from a pure culture of *Bacillus* 6A-1 and sequenced by a contractor (GeneWiz, Inc.) on an Illumina MiSeq system using a shotgun-sequencing approach. The DNA sequences were processed by using MOTHUR (Kozich, J. J., S. L. Westcott, N. T. Baxter, S. K. Highlander, and P. D. Schloss. 2013. Development of a dual-index sequencing strategy and curation pipeline for analyzing amplicon sequence data on the MiSeq Illumina sequencing platform. *Appl Environ Microbiol.* 79(17):5112-5120). Briefly, forward and reverse reads were assembled into continuous DNA sequences ranging in length from approximately 150 to 300 base pairs. Sequences containing ambiguous base calls, long homo-polymer regions, or less than 20 bases of overlap between forward and reverse reads were eliminated from the dataset. Approximately 4.45 million sequences passed these quality control procedures and were retained as a library of shotgun DNA sequences. The consensus sequence of *Bacillus subtilis* 6A-1 is SEQ ID NO: 1. The 4.45 million sequences were aligned with the complete genome sequence of *Bacillus subtilis* strain 168. Approximately 93.1% (4.15 million sequences) belonging to the *Bacillus* 6A-1 library aligned with the reference strain with approximately 89.0% coverage. Third party verification (GeneWiz, Inc.) of genome similarity between *Bacillus* 6A-1 and *Bacillus subtilis* strain 168. The *Bacillus* 6A-1 library was mapped to the reference genome of *Bacillus subtilis* strain 168 (See GenBank Ref No. AL009126 "*Bacillus subtilis* subsp. *Subtilis* str. 168 complete genome" February 2015; NCBI RefSeq NC_000964.3 Aug. 3, 2016) by using CLC genomics workbench software (CLC Bio, Inc.) to produce a consensus partial genome sequence for *Bacillus* 6A-1. The consensus mapped sequence (internal accession number AL009126.3) was aligned with the reference sequence using BLASTn alignment software (NCBI) and was found to align with approximately 89% coverage and 98.9% sequence similarity. These results support classification of *Bacillus* 6A-1 as a subspecies of *Bacillus subtilis*.

A secondary analysis of 16S ribosomal gene similarity, widely recognized as a method of taxonomic assignment, was conducted to compare *Bacillus* 6A-1 with *Bacillus subtilis* strain 168. A subset of 29,044 DNA sequence fragments was identified in the *Bacillus* 6A-1 shotgun library that aligned with the 16S gene of *Bacillus subtilis* 168. Guided-assembly software (DNA Baser v4.31.0) was used to re-construct the 16S sequence fragments into a consensus DNA sequence. Guided assembly was iterated 10 times, and then the consensus sequences produced by each iteration were aligned by using iterative multiple sequence alignment software (MUSCLE, EMBL-EBI). The consensus 16S gene sequence produced by MUSCLE was aligned with the *Bacillus subtilis* 168 16S gene sequence by using BLASTn. The 16S ribosomal gene sequence of *Bacillus* 6A-1 was 99.8% similar (1552 out of 1554 residues). Querying the 16S ribosomal sequence against the non-redundant nucleotide database (NCBI) demonstrated greater than 99% similarity with numerous other strains of *Bacillus subtilis*. Thus, *Bacillus* 6A-1 can be classified as a subspecies of *Bacillus subtilis* on the basis of both 16S and whole-genome shotgun sequencing.

Example 2

Production of Enzyme-Containing Extract from *Bacillus subtilis* 6A-1

An 8 hour aerobic culture of *Bacillus subtilis* 6A-1 was prepared using Minimal *Bacillus* Media (MBM) (composition: Sucrose 10.0 g/L, $K_2HPO_4$ 2.5 g/L, $KH_2PO_4$ 2.5 g/L, $(NH_4)2HPO_4$ 1.0 g/L, $MgSO_47H_2O$, $FeSO_47H_2O$ 0.01 g/L, $MnSO_47H_2O$ 0.007 g/L Reference: *Bacillus* and related endospore-forming bacteria. Bioscience Portal "Biology-Life Science-Edu-Lecture Notes." Nov. 9, 2013. Table 2. https://bioscienceportal.wordpress.com/2013/11/09/bacillus-and-related-endospore-forming-bacteria/) which was amended by replacing Sucrose with Dextrose (10 g/L), and adding $CaCl_2$ (0.12 g/L), $MnCl_2$ (0.05 g/L), and 1% (w/v) Bacto Soytone (BD 243620). The bacterium was incubated at 30° C. for 8 hours. At the end of the incubation period, the bacterial cells were separated from the broth using centrifugation followed by filtration using a 0.45 micron filter. Cellulolytic activity was assayed using the method detailed below. The liquid extracts were then subjected to tests for enzyme activity. Results are detailed in FIG. 1.

Example 3

Cellulase and Amylase Enzyme Activity Determination

One unit of cellulase or amylase activity is defined as the quantity of enzyme that liberates 1 micromole of reducing sugar (expressed as glucose equivalents) per minute from the appropriate substrate under the conditions of the assay described. The cellulase substrate is sodium carboxymethyl cellulose. The amylase substrate is soluble starch (suitable for diastase measurement). For the purposes of this assay substrate and cellulase enzymes reacted in 0.015 M Sodium Acetate Buffer, pH 5.0, prepared from sodium acetate trihydrate and acetic acid. For the purposes of this assay substrate and amylase enzymes reacted in 0.02 M Sodium Phosphate Buffer, pH 6.0, prepared from sodium 0.2M dibasic sodium phosphate and 0.2M monobasic sodium phosphate, corrected to pH 6.0 using 0.1N sodium hydroxide or 0.1N hydrochloric acid.

Glucose standards were prepared in deionized water and a standard curve was constructed for a range of glucose solutions from 0.1 mg/mL to 1.0 mg/mL. To each 0.8 mL of glucose dilution in a glass tube, 1.2 mL of DNS Reagent (1.0% 3,5-dinitro-salicylic acid solution (DNS) was prepared in 0.4 N NaOH with 300 g/L of potassium sodium tartrate.) was added. The tubes containing the standard glucose solutions were placed in boiling water bath for 10 minutes, after which they were cooled rapidly in ice water bath. 2.0 mL of deionized of reducing sugar was read in suitable tubes in a spectrophotometer at 540 nm wavelength water was added to each tube. The reddish orange color developed by the DNS reagent in presence.

A 1.0% Sodium carboxycellulose (CMC) Substrate Solution was prepared from low viscosity carboxymethyl cellulose sodium salt (degree of substitution of 0.60-0.95-viscosity 3,000-6,000 cps). The substrate solution was prepared in the boiling 0.015 M Acetate Buffer which was stirred until substrate was dissolved and tempered in water bath to assay temperature.

The 1% Starch Substrate Solution was prepared by dissolving 1.0 g soluble starch was 90 ml of hot 0.02 M sodium phosphate buffer. Temperature was elevated to gently boil to dissolve substrate. pH was rechecked and adjusted to pH 6.0 with 0.1N sodium hydroxide, if necessary. Volume was adjusted to 100 ml in volumetric flask with buffer. Substrate was tempered in water bath to assay temperature.

The liquid enzyme-containing samples were analyzed in the following manner: to each tube containing 0.40 mL of 1% substrate solution was added 0.40 mL of enzyme-containing solution. After mixing, tubes were incubated at 40° C. for 30.0 minutes. After incubation, 1.2 mL of DNS was added to each tube. Tubes were subjected to a boiling water bath for 10.0 min after which they were immersed in an ice water bath and 2.0 mL of deionized water was added to each tube. The absorbance of the each aliquot of reactant mixture was read in spectrophotometer in suitable tubes at 540 nm wavelength. Each of the samples was run in triplicate for greater accuracy.

One unit of cellulase or amylase activity (DNS method) is defined as the quantity of enzyme that liberates 1.0 micromole of reducing sugar (expressed as glucose equivalents) per minute under the standard conditions of the assay described.

The absorbance value for each enzyme-containing sample was calculated by subtracting the enzyme blank value from the enzyme sample value. The net value was used to calculate the activity value from the standard glucose curve.

$$\text{Activity(Enzyme activity/gram)} = \frac{[\text{Activity value from standard curve} \times \text{dilution}]}{[\text{Micromoles glucose} \times \text{reaction time}]}$$

See FIG. 1.

Example 4

Figure 2:
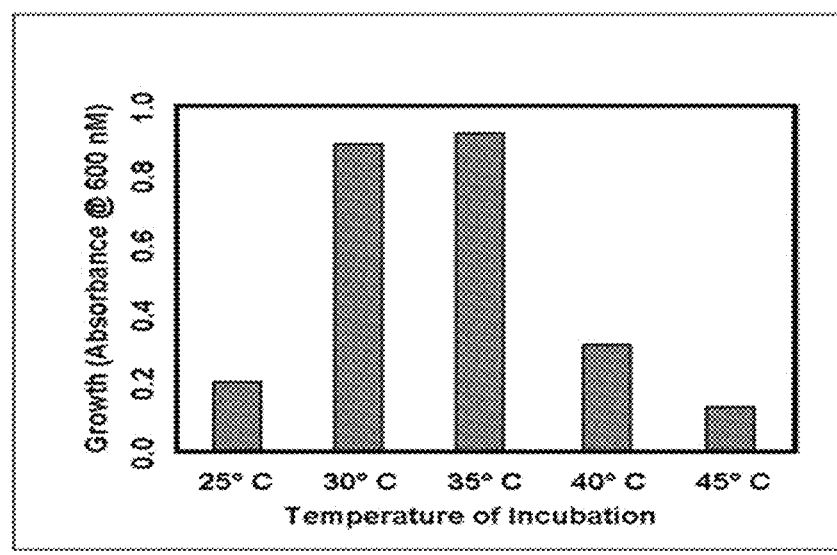
FIG. 2 is a graph showing *Bacillus subtilis* 6A-1 growth relative to temperature.

Growth of *Bacillus subtilis* 6A-1 vs Temperature 100 mL aliquots of Brain Heart Infusion broth were inoculated with 1 mL each of broth containing viable *Bacillus subtilis* 6A-1 cells. After inoculation individual aliquots were incubated at the different temperatures indicated for 12 hours with agitation. Absorbance (optical density) readings (which are direct indicators of bacterial growth and multiplication) were taken at a wavelength of 600 nm. It is apparent from the data presented in FIG. 2 that the optimal temperature for *Bacillus subtilis* 6A-1 growth is 30°-35° Celsius. Growth rates and levels declined steeply at temperatures outside this temperature range. This data indicates that *Bacillus subtilis* 6A-1 is a mesophilic bacterium.

Example 5

Figure 3:
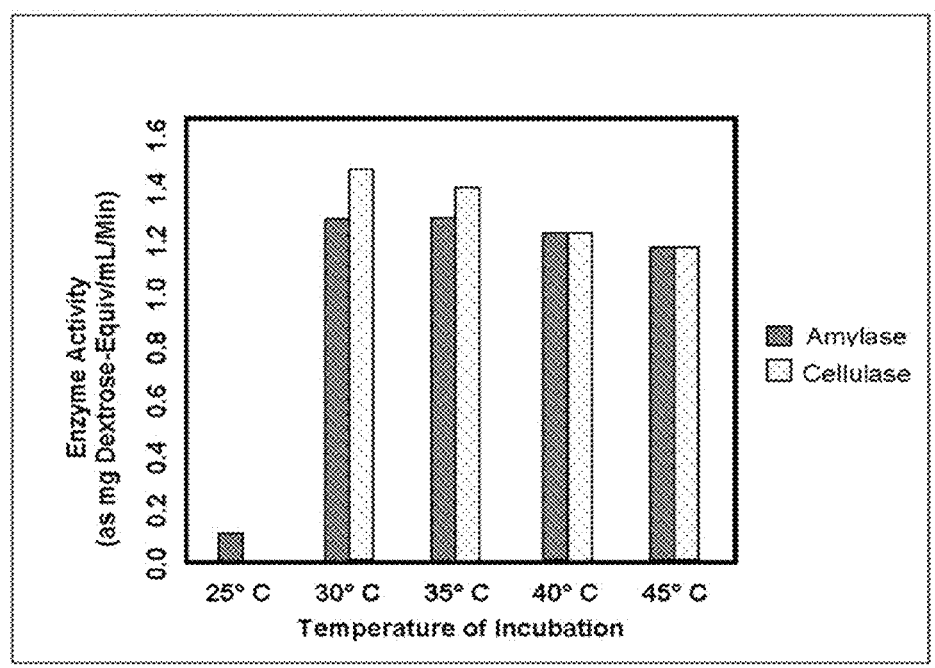
FIG. 3 is a graph showing *Bacillus subtilis* 6A-1 enzyme production relative to temperature. The gray bar shows amylase production and the dotted bar shows cellulose production.

*Bacillus subtilis* 6A-1 Enzyme Production at Different TemperaturesAliquots of 100 mL of Brain Heart Infusion broth were inoculated with 1.0 mL of broth containing viable *Bacillus subtilis* 6A-1 cells. The inoculated broth was incubated at the temperatures indicated for 12 hours with agitation. Samples of broth were taken at the 12 hour point and each sample was centrifuged at 3000 rpm for 20 min. The supernatant was harvested. These broth supernatant samples were analyzed for cellulase and amylase activity using the CMC-DNS and Starch-DNS Method described above. Results are reported in FIG. 3. The experiment indicated that the optimal temperature range for amylase and cellulase production by *Bacillus subtilis* 6A-1 is in the 30°-35° Celsius range. Cellulase and amylase activity was assessed using the protocol described in Cellulase and Amylase Enzyme Activity Determination.

Example 6

Enzyme Activity on Polysaccharides

Growth experiments and detailed examinations of this bacterium revealed that the strain excreted enzymes which exhibit novel cellulase activity over a broad pH range.

Figure 4:
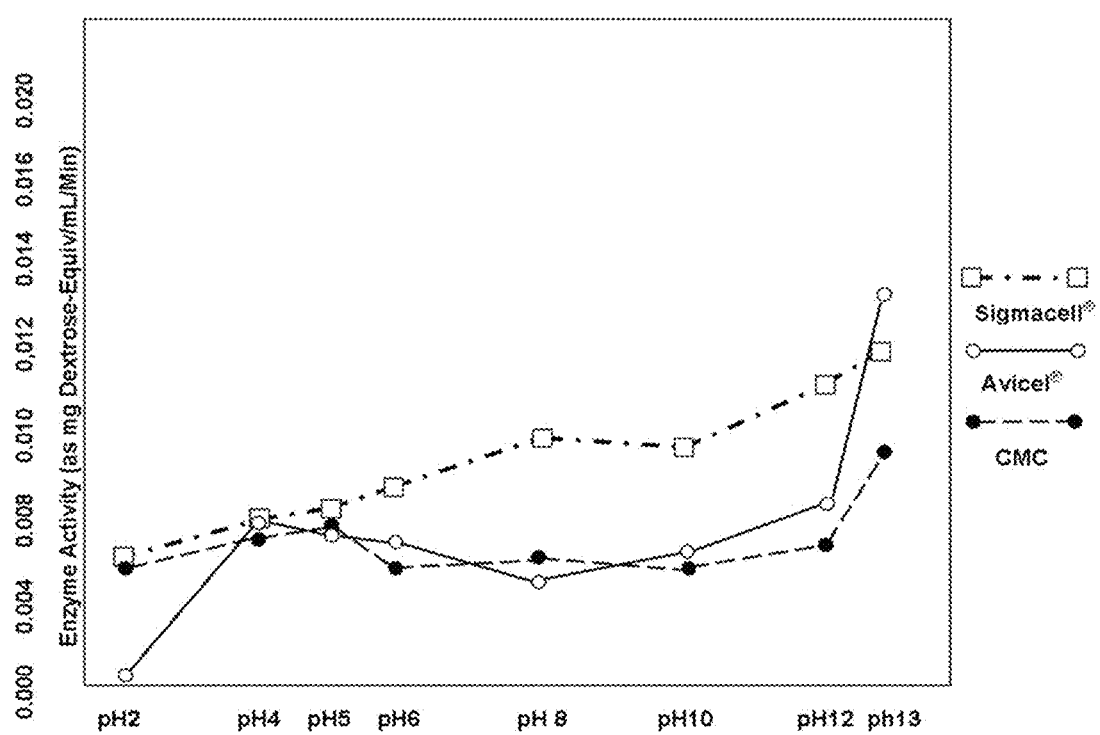
FIG. 4 is a graph showing *Bacillus subtilis* 6A-1 enzyme activity on three types of cellulose at various pH levels. The dash and dot line shows activity the microcrystalline cellulose Sigmacell® cellulose, the straight line shows activity on the Avicel® cellulose.

The bacteria produced hydrolytic enzymes. It was discovered by the inventors that the *Bacillus subtilis* 6A-1 (SD-6861) produced three protein fractions and exhibited activity not only on carboxymethyl cellulose (CMC), a compound that is the result of chemically modifying cellulose to render it more soluble, but also on native, crystalline cellulose. Examples of commercial versions of purified, crystalline, water-insoluble cellulose are SigmaCell® and Avicel®. Avicel® used for this research was Avicel® (Type PH 101) (CAS 9004-34-6) manufactured and supplied by FMC Biopolymer (FMC BioPolymer 1735 Market Street Philadelphia, Pa. 19103). Sigmacell® (Catalog Number S3504) is marketed by Sigma-Aldrich® and is a microcrystalline cellulose preparation of finely divided microcrystalline cellulose which retains crystalline integrity but can be more easily dispersed in aqueous suspensions. The protein fractions showed this activity over a broad pH range from pH 2.0-13 (See FIG. 4).

Aliquots of 1 mL of enzyme-containing broth were added to aliquots of 4 mL of the appropriate pH buffer (See Buffer Solutions—below) along with 0.10 g of polysaccharide to be tested. The reactant mixtures were incubated with agitation at 40° C. At the end of incubation time (1 hour), the reacting mixture was chilled in a 0° C. ice bath and filtered through a 0.45 micron filter. 450 µL of each sample was withdrawn and analyzed for reducing sugar generated by the enzyme reacting with the said polysaccharide by the method of Miloski et. al. (2008)—Miloski, K., Wallace, K., Fenger, A., Schneider, E., and Bendinskas, K. "Comparison of Biochemical and Chemical Digestion and Detection Methods for Carbohydrates." *American Journal of Undergraduate Research*. 2008. 7 (2):7-18.

The 450 µL aliquot of each sample was pipetted into new microfuge tubes. A 450 µL aliquot of 3,5-dinitrosalicylic acid (1%) prepared in 0.4N NaOH was added to each tube. Samples were immersed in a 90° C. hot water bath for 10 minutes. After removal from the bath, 150 µL of sodium potassium tartrate (40%) was added to each tube. A 300 µL aliquot of each sample was pipetted into separate wells of a 96-well microplate. Absorbance was read at 575 nanometers with a plate reader and the average absorbance for each triplicate set was calculated.

| Buffer Solutions | |
|---|---|
| pH 2 | Citric Acid-$Na_2$ $HPO_4$ Preparation: Mixed 89.1 mL of 0.1M Citric Acid and 10.90 mL of 0.2M $Na_2$ $HPO_4$ then solution titrated with 1M HCl to pH 2.0 |
| pH 4 | Citric Acid-$Na_2$ $HPO_4$ Preparation: Mixed 61.45 mL of 0.1M Citric Acid and 38.55 mL of 0.2M $Na_2$ $HPO_4$ then solution titrated with 1M HCl to pH 4.0 |
| pH 6 | Citric Acid-$Na_2$ $HPO_4$ Preparation: Mixed 36.85 mL of 0.1M Citric Acid and 63.15 mL 0.2M $Na_2$ $HPO_4$ then solution titrated with 1M HCl to pH 6.0 |
| pH 8 | $Na_2$ $HPO_4$—$NaH_2PO_4$ Preparation: Mixed 47.35 mL of 0.2M $NaH_2PO_4$ and 2.65 mL of 0.2M $Na_2$ $HPO_4$ then solution titrated with 1M HCl to pH 8.0 |
| pH 10 | $Na_2CO_3$—$NaHCO_3$ Preparation: Mixed 60 mL of 0.1M $Na_2CO_3$ and 40 mL 0.1M $NaHCO_3$ then solution titrated to pH 10.0 |
| pH 12 | KCl—NaOH Preparation: Mixed 25 mL of 0.2M KCl and 6.0 of 0.2M NaOH then diluted with water to a volume of 100 mL. Rechecked pH. |
| pH 13 | KCl—NaOH Preparation: Mixed 25 mL of 0.2M KCl and 66 mL of 0.2M NaOH then diluted with water to a volume of 100 mL. Rechecked pH. |

Experimentation has shown that overall cellulolytic enzyme activity that is exhibited by *Bacillus subtilis* 6A-1 is effective upon several forms of cellulose substrate. With the commercial micro-crystalline cellulose, Avicel®, at least two peaks of cellulase activity occur, one indicating an acidophilic/neutral-acting cellulase enzyme system, another peak indicating an alkaliphilic cellulose-digesting enzyme system (See FIG. 4). At the same time, additional research has shown that the action pattern of the cellulolytic enzyme systems on carboxymethyl cellulose (CMC) is very similar. However, tests utilizing another commercial microcrystalline cellulase, Sigmacell® as substrate reveal that activity by 6A-1 cellulases are similarly active in the acidic pH ranges, and increasingly active in neutral and alkaline pH ranges. The result of this data indicates that the cellulolytic activity of the enzymes expressed and secreted by *Bacillus subtilis* 6A-1 are novel in that they are active throughout the range from pH 2.0 to pH 13.0 on chemically modified and unmodified cellulosic compounds.

The *Bacillus subtilis* 6A-1 (SD6861) produces crystalline cellulose-digesting enzymes. These enzymes are usually characterized as being exo-acting cellulases beginning their hydrolytic at the outside edges of the polymeric cellulose structure. In addition, the enzyme systems can digest modified cellulose (such as carboxymethyl cellulose or CMC). CMC-digesting enzymes are usually described as being more endo-acting cellulases, beginning their hydrolysis in the center of the polymeric cellulose structure.

The use of the strain provides optimal efficacy in a broad range of applications that a combination of cellulase activity is utilized. If one applies cellulases of different types with activity ranging over broad expanses of pH, then the greatest efficacy can often be achieved.

Biochemical processes which vary in pH throughout their progression will benefit from broad pH range efficacy. One example is an ensilage fermentation which starts at pH 6.8-7.0 and finishes at 3.5-3.9. Another example is a feeding process that involves the animal gut which may start at pH 6.6-7.0, continues through pH levels reaching 2.0 or even lower, and finishes at 6.4-6.8.

Example 7

Cellulolytic Activity on Native Sources of Polysaccharides

Figure 5:
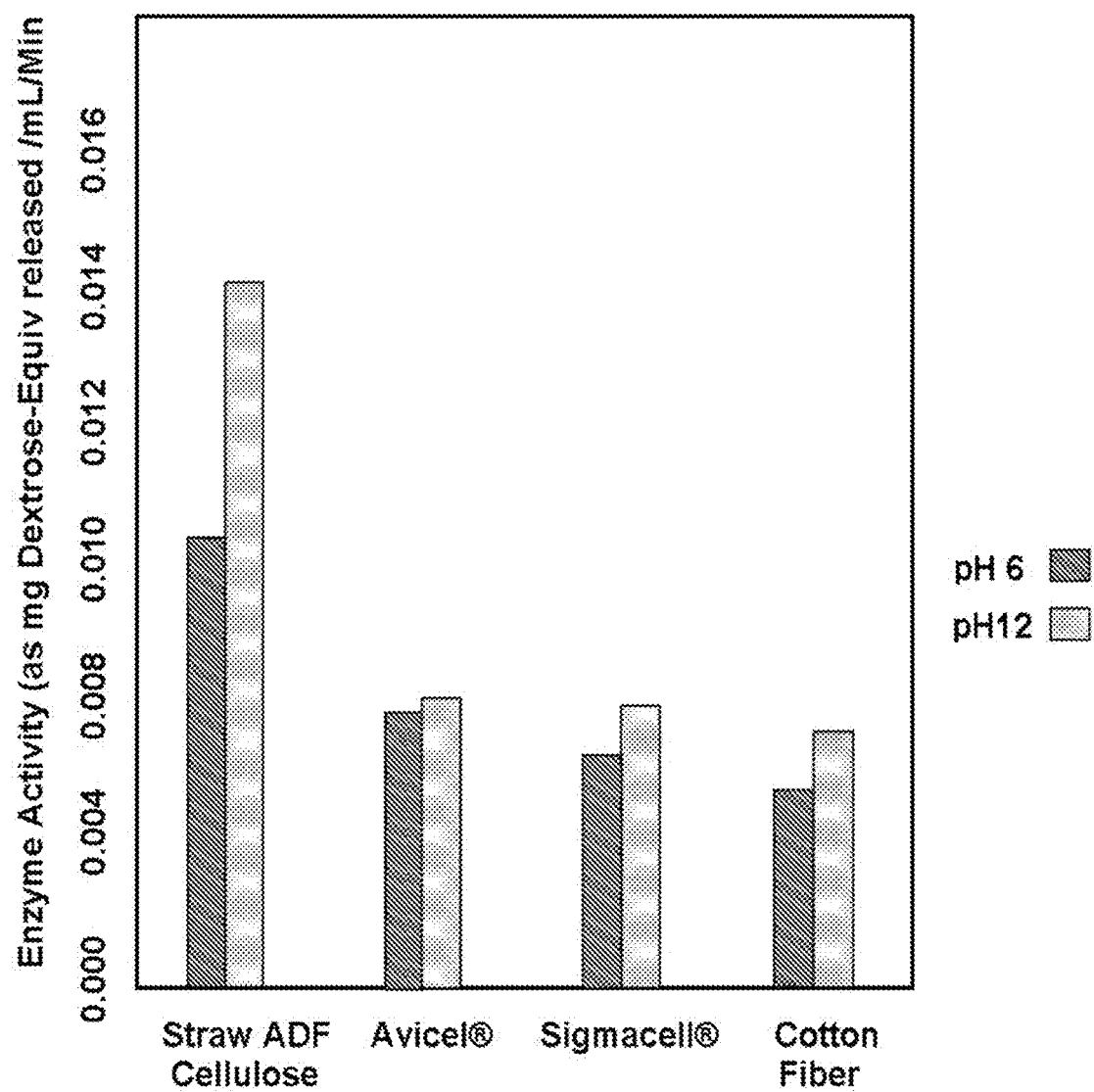
FIG. 5 is a graph showing enzyme activity on straw ADF cellulose, Avicel® cellulose, Sigmacell® cellulose and cotton fiber. The dark hatched bar shows activity at pH6, the lighter dotted bar shows activity at pH12.

Although it is definitively shown that the enzyme systems of Bacillus subtilis 6A-1 are active on several types of crystalline and modified cellulase preparations, enzyme-containing broth of Bacillus subtilis 6A-1 was additionally analyzed for its cellulolytic activity upon unmodified cellulose from native sources: delignified "ADF cellulose" derived from delignified, acid detergent fiber treatment of wheat straw, and from absorbent cotton. The results are shown in FIG. 5 below.

Native cellulose derived from delignified ADF residue: Acid Detergent Fiber was prepared from wheat straw and delignified according the following method.

A 5.0 gram sample of ground dry wheat straw (at 0.8 mm grind size) was subjected to boiling with 500 ml Acid Detergent Fiber Solution (prepared by adding 20 g cetyl trimethylammonium bromide (CTAB) to 1 L 1.00N $H_2SO_4$) for 60 minutes. The spent liquid, after 60 minutes, contained Acid Detergent Solubles which were separated by filtration. The insoluble residue was rinsed twice with hot distilled water, and subjected again to boiling with ADF solution for another 60 minutes. The final residue of the procedure was identified as ADF straw residue.

This residue, containing cellulose, lignin, and an insignificant amount of heat damaged protein and a portion of cell wall protein and minerals (ash) was subjected to saturated potassium permanganate combined with lignin buffer Solution at ratio 2:1 (see material preparation below).

The lignin buffer solution contained 6.0 g of ferric nitrate nonahydrate and 0.15 g silver nitrate made into 100 ml with distilled water. The mixture was combined with 500 ml glacial acetic acid and 5.0 g potassium acetate. The whole contents were brought to 1.0 liter by adding 400 mL of tert-butanol (2-methyl-2-propanol). 50.0 g $KMNO_4$ was dissolved in distilled water and brought to total volume of one liter with distilled water to prepare a 5% solution.

ADF straw residue was placed in a 500 ml beaker and the contents were covered with potassium permanganate solution treatment and stirred with a glass rod to a smooth paste. Refilling with potassium permanganate solution and stirring occasionally until the contents were poured into Gooche crucibles and the liquid was filtered off with aspirators as the acid drained away.

After 90 minutes the oxidizing solution was filtered to remove as much acid as possible with vacuum and the contents were treated with the demineralizing solution (50.0 g of oxalic acid dihydrate into 700 ml of 95% ethyl alcohol, then add and mix 50 ml concentrated (12N) hydrochloric and 250 ml distilled water). The treatment was repeated twice, and the cellulosic residue became white. The delignified white residue was washed with hot water until free from acid. The white residue (native wheat straw cellulose or Straw ADF Cellulose) was dried at 65° C.

Absorbent cotton (Swisspers® brand Cotton Balls Jumbo Plus—manufactured by U.S. Cotton, LLC, 15501 Industrial Parkway, Cleveland, Ohio 44135) was obtained commercially for use in the analytical procedure. For the analytical procedure, approximately 0.1 g was cut and placed in tubes used for the enzyme hydrolysis.

Both the straw ADF cellulose and the cotton substrates were tested for susceptibility to Bacillus subtilis 6A-1 cellulase enzymes by applying enzyme-containing broth and the enzyme activity was calculated in the same manner as in previously described experiments (Enzyme Activity on Polysaccharides). For contemporaneous comparison, the analysis set also included Avicel® and Sigmacell®1 substrates as in previous experiments. FIG. 5 illustrates the results of the test. The results again confirm the broad activity on Avicel® and Sigmacell® microcrystalline celluloses, but also reveal that the enzymes of 6A-1 also act upon native straw cellulose, and native cotton cellulose over broad range of pH values.

Figure 6:
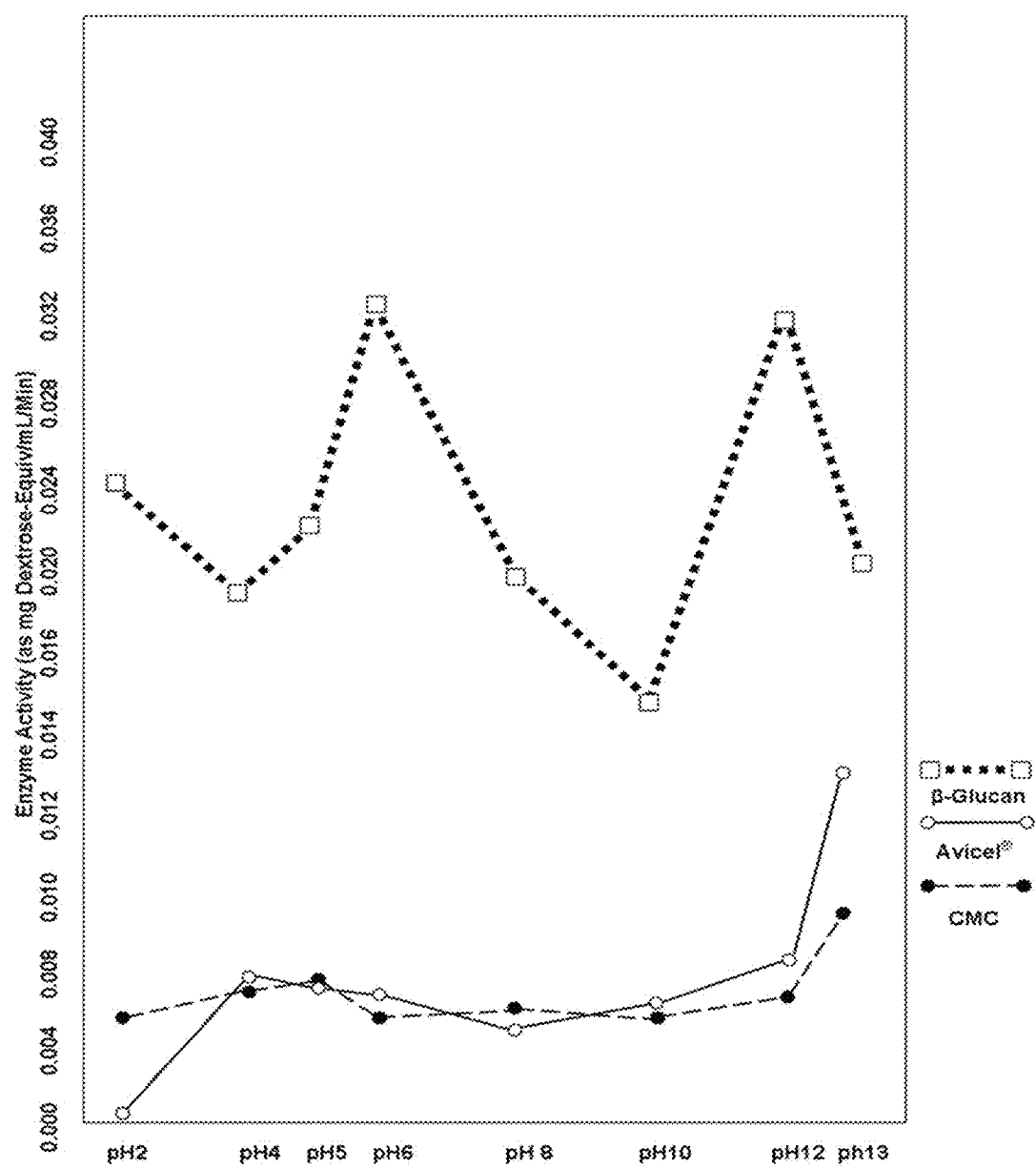
FIG. 6 is a graph showing *Bacillus subtilis* 6A-1 enzyme activity on β-glucan (from barley) at various pH levels as compared to activity on Avicel® and carboxymethyl cellulose.

FIG. 6 summarizes Bacillus subtilis 6A-1 β-glucanase activity on barley β-glucan along with comparative cellulase activity on two types of cellulose provided for reference. Cellulose and the β-glucan from certain grains and legumes represent separate types of β-glucan compounds with similar linkage. Native cellulose and micro-crystalline cellulose are β-glucans, but their structure is more crystalline in nature and less vulnerable to hydrolytic attack by bacterial enzymes. Nevertheless, it is apparent that enzymes produced and secreted by 6A-1 are capable of degrading both cellulose and barley β-glucans.

While the β-glucanase activity of enzymes produced by Bacillus subtilis 6A-1 are effective on barley β-glucan over the broad pH range of 2.0-13.0, there are peaks of activity at approximately pH 2.0, 5.0, and 12.0. These activity peaks almost assuredly point to more than one enzyme being present which can catalyze the hydrolysis of barley β-glucan. Barley β-glucan is but one example of this type of NSP present in oats, soy beans and their derivatives and other more difficult-to-digest grains and legumes. β-glucans represent one class of compound that is present in animal feedstuffs that is difficult to digest by certain livestock and poultry.

Further, Bacillus subtilis 6A-1 is unique in that the bacterium produces other enzymes which catalyze the hydrolysis of polysaccharides other than barley β-glucan and cellulose. We have discovered that the bacterium is also capable of producing enzymes which degrade the following compounds:

Lichenin (CAS 1402-10-4)—A complex β-glucan which can be isolated from Icelandic moss. According to several references, lichenin (also known as lichenan) consists of a polysaccharide with repeating glucose units linked by β-1,3 and β-1,4 glycosidic bonds.
(Perlin, A. S. and S. Suzuki. The Structure of lichenin: Selective Enzymolysis. *Canadian Journal of Chemistry*. Volume 40 (1962))

Laminarin—which is an NSP made up of β (1→3) (linked) glucan structure with β (1→6) (linked) branch points. It is a linear polysaccharide. Its hydrolysis is catalyzed by enzymes such as laminarinase (EC 3.2.1.6) that breaks the β (1→3) bonds. (Salyers A A, Palmer J K, Wilkins T D. Laminarinase (beta-glucanase) activity in *Bacteroides* from the human colon. *Appl Environ Microbiol*. (May 1977). (England) 33 (5): 1118-1124))

Xylan (CAS 9014-63-5)—which is composed of hemicelluloses that are found in plant cell walls and in some algae. Xylans are polysaccharides constructed from units of xylose. Xylans are almost as ubiquitous as cellulose in plant cell walls and contain predominantly β-D-xylose units linked in similar manner to the monomers in cellulose. (Alonso J L, Dominguez H, Garrote G, Parajo J C, Vazques M J (2003). "Xylooligosaccharides: properties and production technologies". *Electron. J. Environ. Agric. Food Chem*

2 (1): 230-232; M. L. T. M. Polizeli, A. C. S. Rizzatti, R. Monti, H. F. Terenzi, J. A. Jorge, D. S. Amorim. Xylanases from fungi: properties and industrial applications. Appl Microbiol Biotechnol (2005) 67: 577-591; K. Beg •M. Kapoor •L. Mahajan •G. S. Hoondal, Microbial xylanases and their industrial applications: a review Appl Microbiol Biotechnol (2001).)

Starch (CAS 9005-25-8)—an α-glucan, which is the predominant carbohydrate storage compound of potatoes, corn and other vegetables and grain. Unlike the polysaccharides above, starch is composed of amylose (CAS 9005-82-7) and amylopectin (CAS 9037-22-3) which are polymers of predominantly α (1→4) linked glucose monomers. Amylose is a straight chained polymer with α (1→4) linked monomers, while amylopectin is branching polymer linked predominantly by α (1→4) linked glucose monomers, but with α (1→6) branch points.

Figure 7:
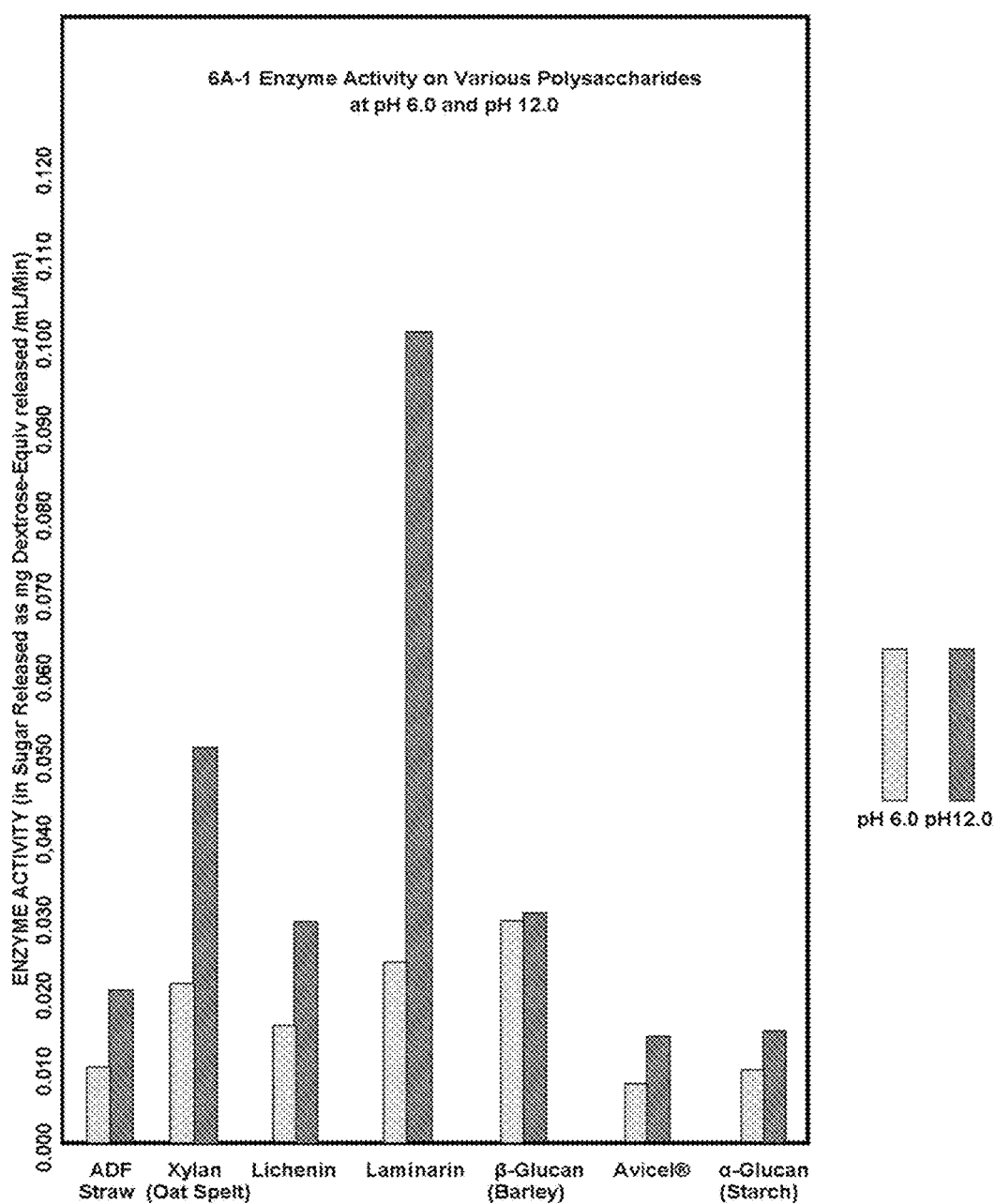
FIG. 7 is a graph showing *Bacillus subtilis* 6A-1 enzyme activity on various polysaccharides at pH6.0 and pH 12.0. The light gray bar shows activity and pH 6.0 and the dark gray bar show activity at pH 12.0.
Figure 8:
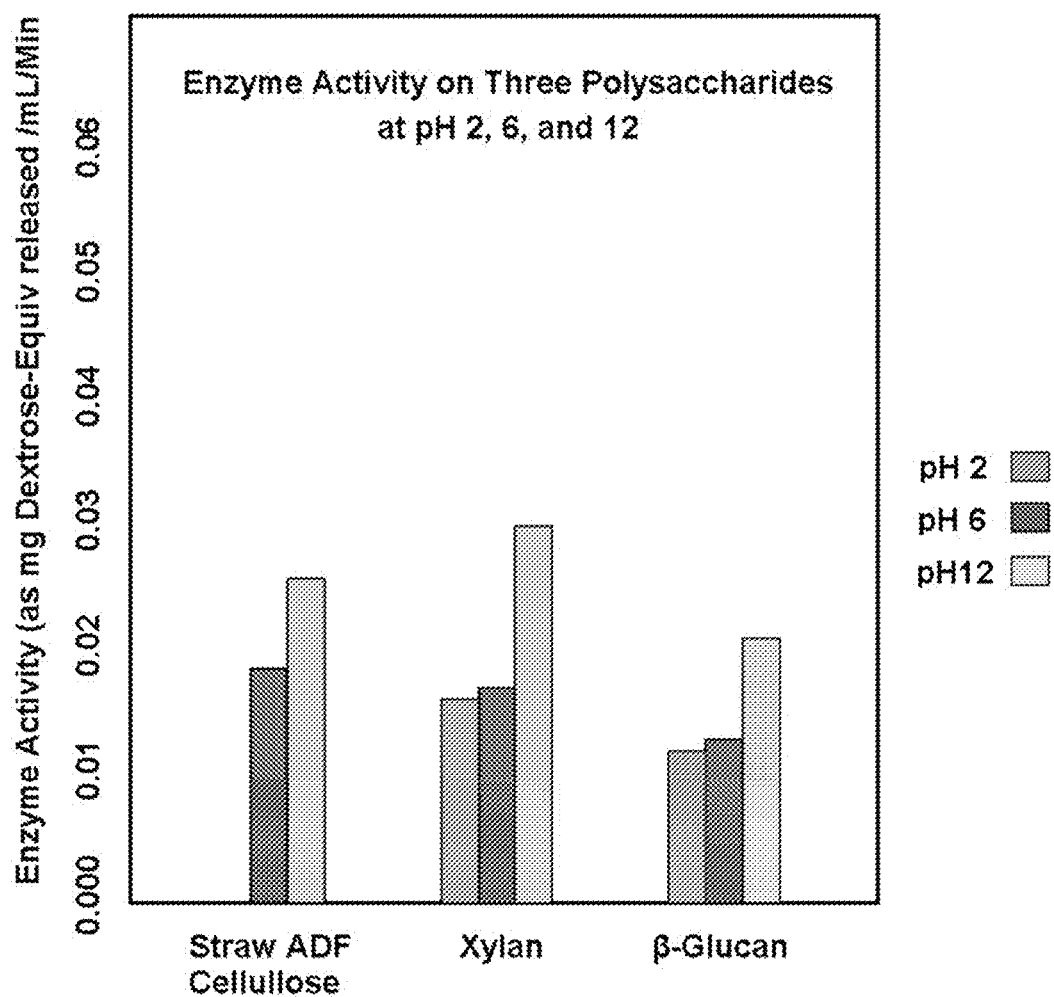
FIG. 8 shows *Bacillus subtilis* 6A-1 activity on three polysaccharides at pH 2.0, 6.0 and 12.0. The gray bar with hatched lines to the right shows activity at pH 2.0, the dark gray bar with hatched lines to the left shows activity at pH 6.0 and the dotted bar shows activity at pH 12.0.

The enzymes which catalyze the hydrolysis of starch are known as (EC 3.2.1). The predominant amylase produced by bacilli is alpha-amylase (EC 3.2.1.1) (CAS 9014-71-5). FIGS. 7 and 8 illustrate the hydrolytic catalyzing activity of the enzymes produced by *Bacillus subtilis* 6A-1 on these diverse polymeric carbohydrate compounds: starch and non-starch polysaccharides. The enzymes expressed and excreted by *Bacillus subtilis* 6A-1 exhibit activity in the neutral area (pH 6.0) and in the highly alkaline area (pH 12.0) of the pH scale. The protocol for the experiment employed the procedures described above at Enzyme Activity on Polysaccharides.

*Bacillus subtilis* 6A-1 strain cells, spores, and enzymes produced can reduce flatulence compared to a feed which does not comprise 6A-1, cells or spores or enzymes. Flatulence in animals may occur due to bacterial action upon undigested and unassimilated nonstarch polysaccharides. This flatulence includes production of gases during digestion such as methane ($CH_4$) and other greenhouse gases that present an environmental or safety issue with certain livestock and other animals.

Example 8

Activity of *Bacillus subtilis* 6A-1 on Acid Detergent Fiber Residue

Acid Detergent Fiber (ADF) residue is the fraction of feed which is a component produced during routine feed analysis. ADF represents the fiber portion of the feed sample that is most difficult for animals to digest. A sample of straw fiber was subjected to standard procedures for production and measurement of ADF (See procedure in Cellulolytic Activity on Native Sources of Polysaccharides). The ADF portion which contained 17% lignin was subjected to attack by 100 microliters of enzyme-containing fermentation broth supernatant from *Bacillus subtilis* 6A-1. A sample of ADF residue so treated would be composed of cellulose and lignin.

Figure 9:
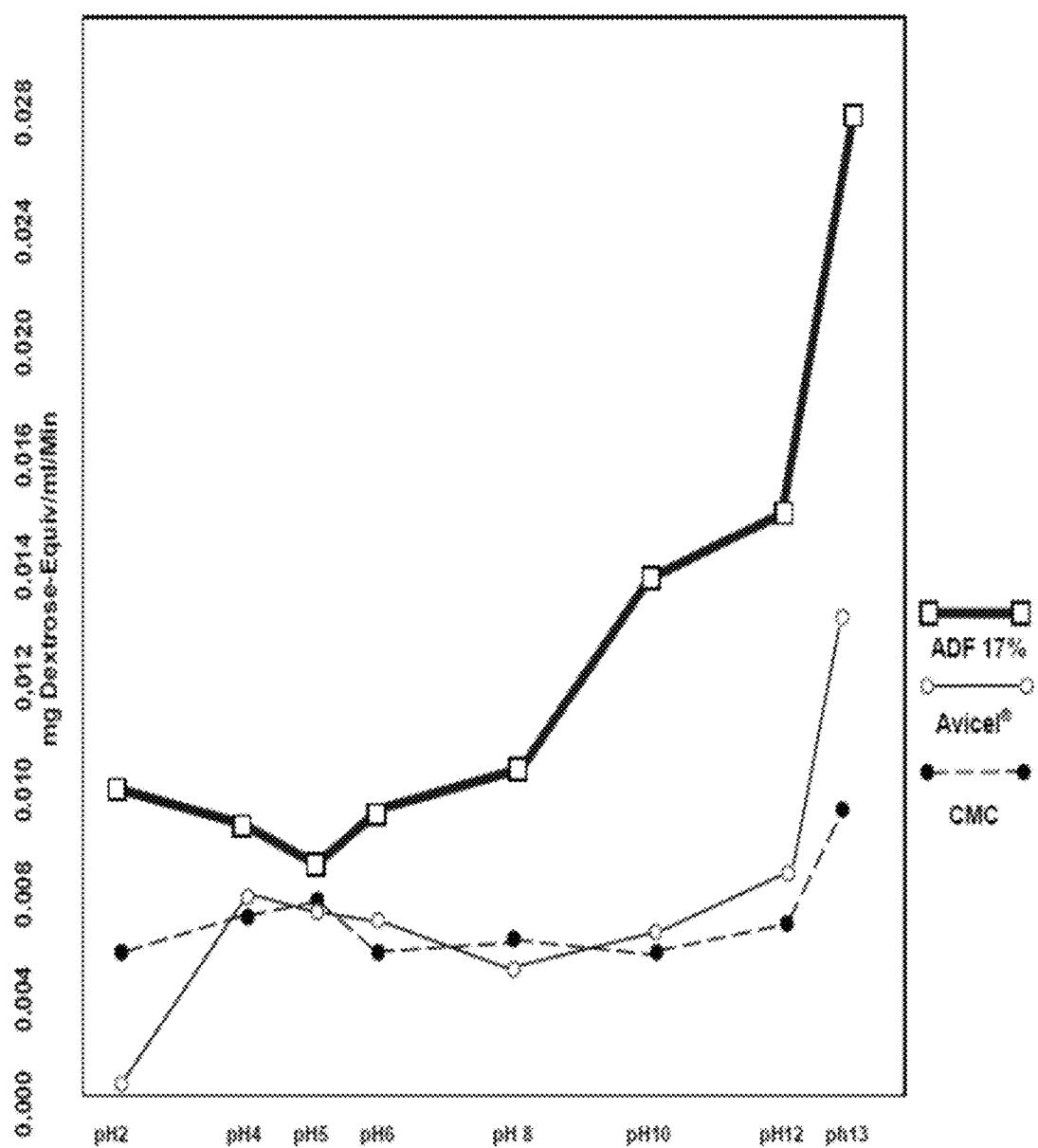
FIG. 9 shows sugar released from Avicel® celluloses and carboxymethyl cellulose (CMC) and Acid Detergent Fiber (ADF) 17% lignin (from straw) at various pH levels upon contact with *Bacillus subtilis* 6A-1 broth (100 μl). The line with square points is ADF 17%, the open circles are Avicel® and the darkened circles are CMC.
Figure 10:
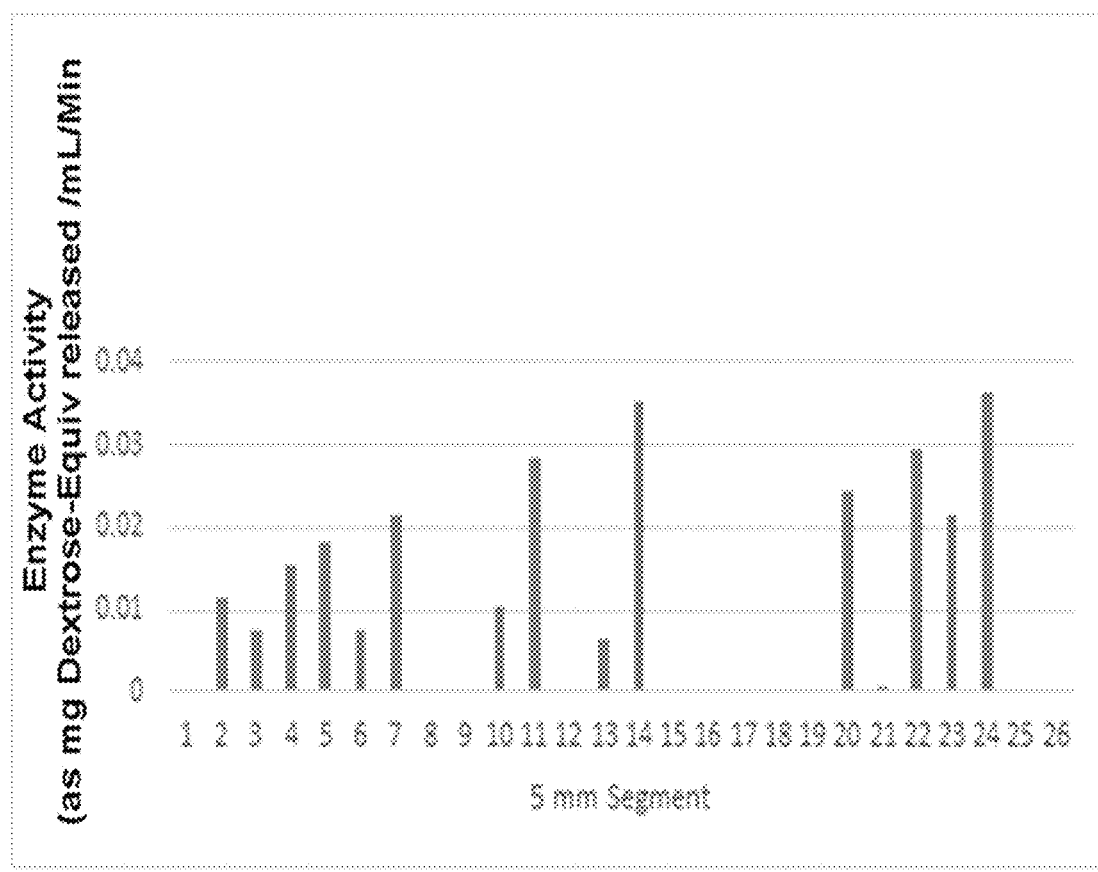
FIG. 10 is a graph showing *Bacillus subtilis* 6A-1 cellulase activity measured by Cellulase and Amylase Enzyme Activity Determination at a pH of 6.3.
Figure 11:
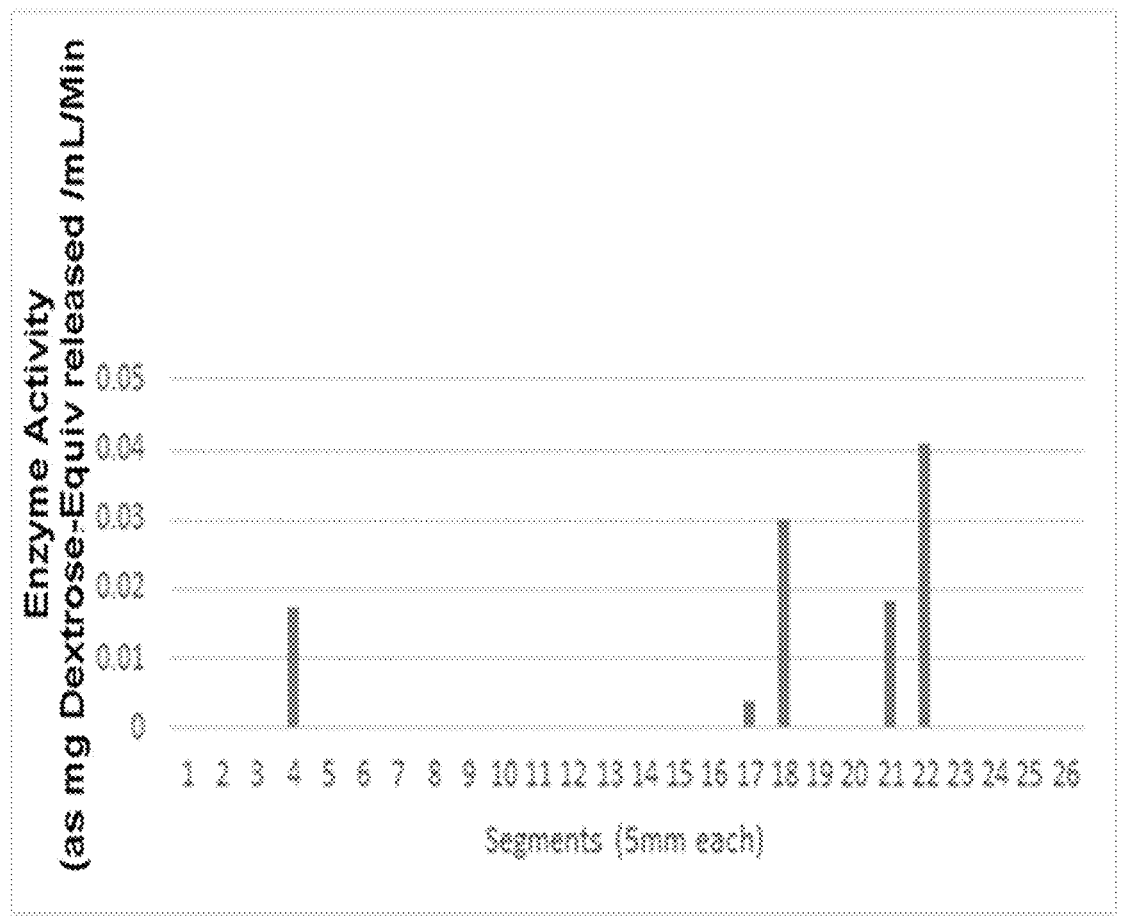
FIG. 11 is a graph showing cellulose activity measure by Cellulase and Amylase Enzyme Activity Determination at pH of 11.12.
Figure 12:
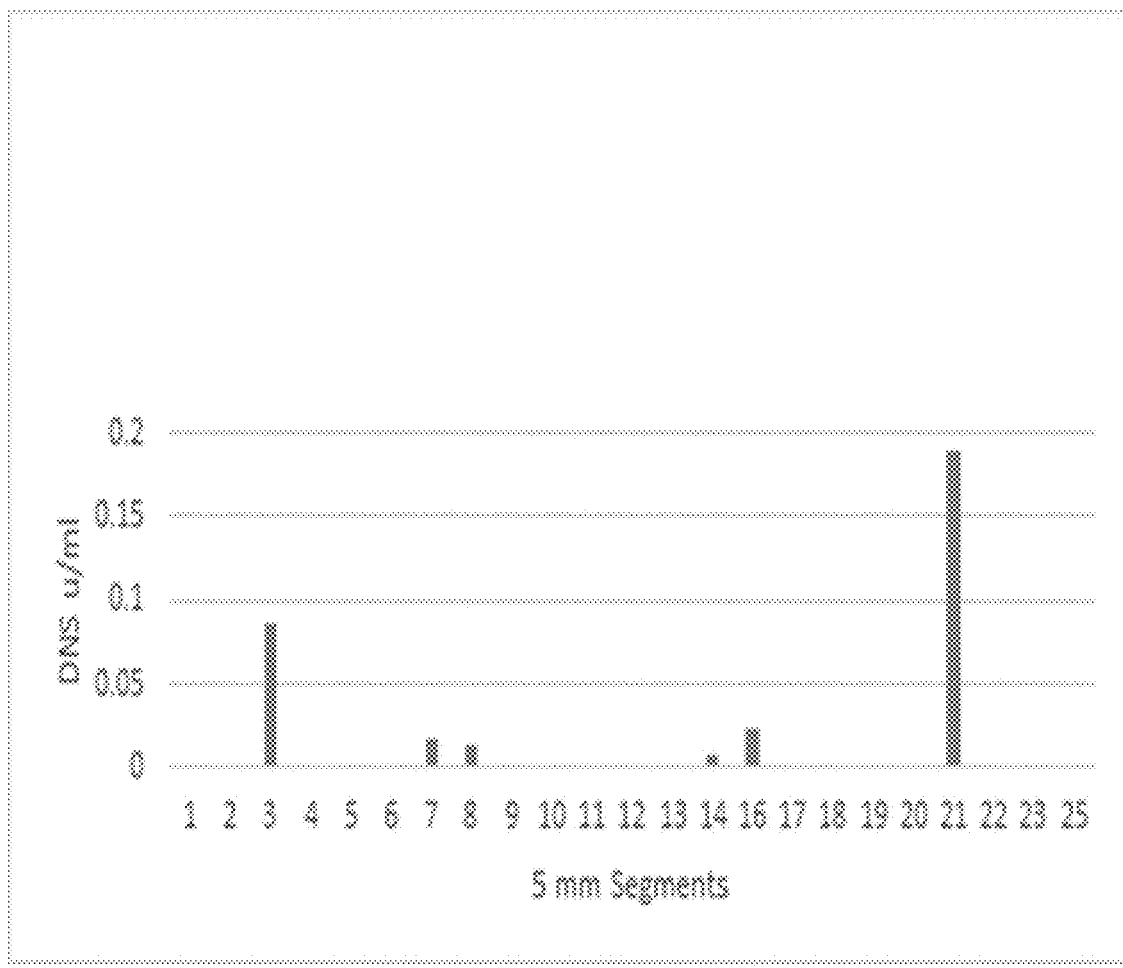
FIG. 12 is a graph showing digestion of Avicel® cellulose using β-alanine acetic acid 8% PAG gel segment elutions at a pH of 6.3.
Figure 13:
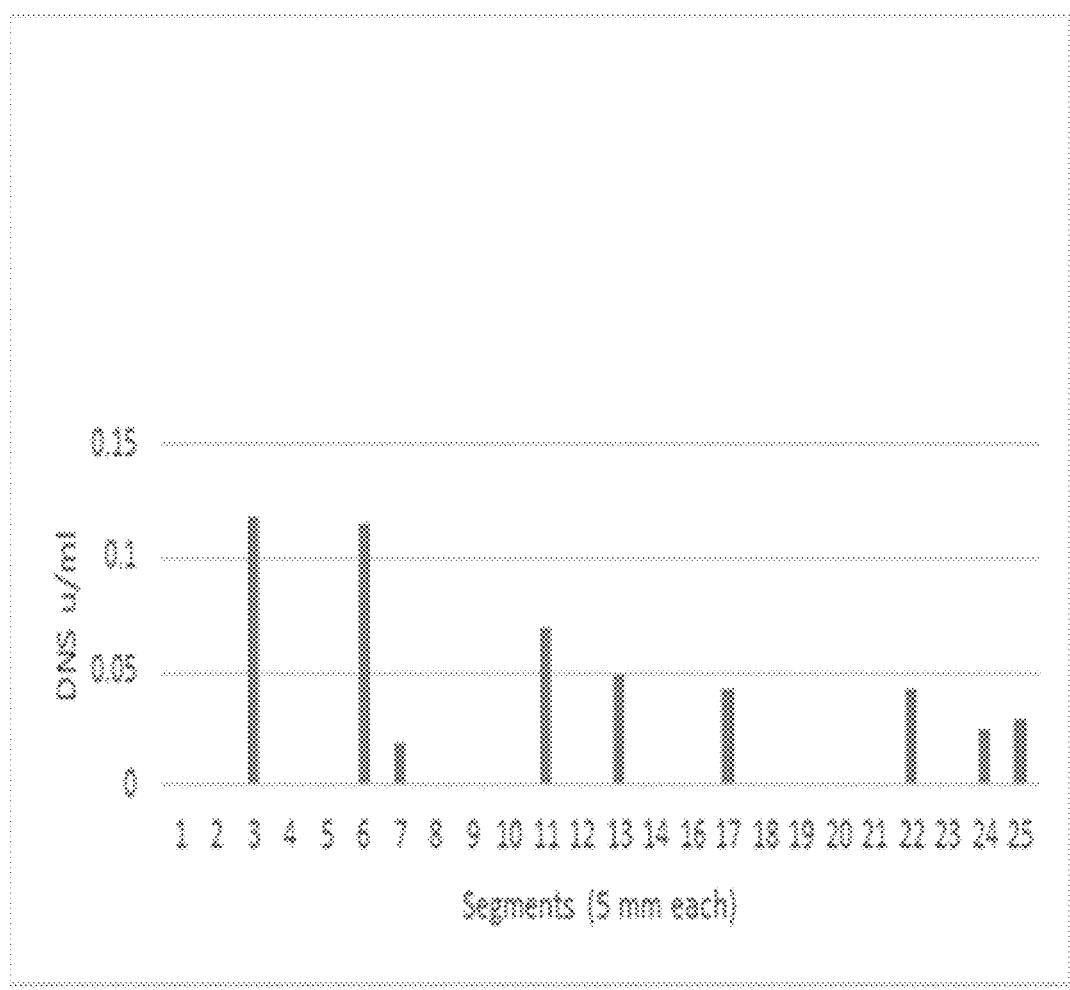
FIG. 13 is a graph showing digestion of Avicel® cellulose using β-alanine acetic acid 8% PAG gel segment elutions at a pH of 11.12.

FIG. 9 graphically represents the activity of the enzymes from *Bacillus subtilis* 6A-1 on native cellulose extracted chemically from wheat straw. The data reveals that hydrolytic digestion of the cellulose in the ADF fraction occurs from pH 2 to pH 13, with the highest levels of sugar-producing hydrolytic activity occurring at the lowest range of pH (2.0) and at the highest point of monitoring (pH 13.0). The experiment below used the protocol described above in Enzyme Activity on Polysaccharides.

ADF residue fractions of feedstuffs can be in the range of 3% to 95%. ADF may be, for example, about 3% in corn and 95% in small grain straw residue. Small grains include, for example: wheat, barley, triticale, rye, oats, and spelt. Small grain straws may also include rice straw and stems or non-grain components of certain other crops indigenous to other specific geographic areas such as rice straw and hulls, and maize and sorghum stover.

Example 9

Separation and Characterization of Cellulolytic Enzyme Fractions from *Bacillus subtilis* 6A-1

Subsequent separation of active cellulolytic enzyme proteins via electrophoresis, according to the method of de Lourdes et al. (Maria de Lourdes T. M. Polizeli, Simone C. Peixoto-Nogueria, Tony M. da Silva, Alexandre Mailer and Hamilton Cabral (2012). Gel Electrophoresis for Investigation Enzymes with Biotechnological Application, Gel Electrophoresis—Advanced Techniquies, Dr. Samah Magdeldin (Ed.), ISBM: 978-953-51-0457-5, In Tech, Available from worldwide webintechopen.com/books/gel-electrophoresis-advanced-techniques/enzymes-with-biotechnological-application), have revealed that *Bacillus subtilis* 6A-1 produces three distinct and separate enzyme fractions which demonstrate hydrolytic enzyme activity toward fiber, using CMC and microcrystalline cellulose (Avicel®) as a substrate. (See FIGS. 10, 11, 12 and 13)

The CMC-DNS assay is described above (Cellulase and Amylase Enzyme Activity Determination). See below for the variation of the analysis which requires elution of the active cellulase enzymes which may be imbedded in the polyacrylamide gel slices prior to running the DNS cellulase procedure described above.

Cellulase enzyme fractions which were produced by *Bacillus subtilis* 6A-1 were separated by polyacrylamide gel electrophoresis according to the technique described by de Lourdes, et. al. Approximately 3 mL of enzyme-containing *Bacillus subtilis* 6A-1 broth supernatant (prepared as in above Production of enzyme-containing extract from *Bacillus subtilis* 6A-1) was dialyzed 18 hours against polyethyleneglycol (PEG) 6000 solution at 4° C. The PEG solution was prepared by adding 200.0 g of PEG in 250 mL of deionized water and heating until PEG dissolved in water. The volume was adjusted to 500 mL. 200 µL of distilled water was added back to the dialyzed sample and the inside of the dialysis tubing was rinsed to obtain as much of the dialyzed enzyme-containing *Bacillus subtilis* 6A-1 broth sample as possible. An 8.0% native polyacrylamide gel electrophoresis (PAGE) gel was prepared for alkaline proteins (as specified in de Lourdes, et. al., p 102). Three wells of the gel were loaded with dialyzed *Bacillus subtilis* 6A-1 enzyme-containing supernatant and were subjected to electrophoresis at 120 V for 4.0 hours using a β-alanine acetic acid mixture as running buffer. The β-alanine acetic acid mixture consisted of 31.2 g of β-alanine, 8 mL of glacial acetic acid and an amount of distilled water sufficient to bring final volume to 1.0 L After the period of electrophoresis, the gel was sliced into 5 mm segments and each segment was placed in separate tubes containing 1 mL of 0.1 M potassium phosphate buffer at pH 7.0. The proteins were allowed to elute into the buffer solution for 48 hours at 4° C. These solutions were then assayed using a CMC-DNS assay for cellulase activity (see Cellulase and Amylase Enzyme Activity Determination). Treatments of gel samples to elute enzymes prior to analysis for CMC cellulolytic activity were the same as the method described for Avicel® cellulolytic activity described below.

The presence of three separate proteins (enzymes) with cellulose-digesting activity secreted [excreted] during the fermentation of *Bacillus subtilis* 6A-1 is surprising. It is apparent that the presence of three separate enzyme fractions identified in the culture supernatant can have an extraordinary advantage in a wide variety of applications.

The procedure was repeated and the cellulolytic enzymes separated by gel electrophoresis were analyzed at pH 11.12 instead of 6.3. The results may be seen in FIG. 11.

In addition to activity expressed upon CMC, gel electrophoresis experiments were expanded to make use of crystalline, more resistant form of cellulose. Similar experiments were executed determining the activity of various protein fractions' catalytic activity upon Avicel®. The results are expressed graphically in FIGS. 12 and 13.

Preparation and analysis of PAG gel segments for cellulase activity expressed on Avicel® microcrystalline cellulose substrate was performed as follows. *Bacillus subtilis* 6A-1 supernatant was run on an 8.0% native polyacrylamide gel electrophoresis (PAGE) gel was prepared for alkaline proteins (as specified in de Lourdes, et. al., p 102). Three wells of the gel were loaded with dialyzed *Bacillus subtilis* 6A-1 enzyme-containing supernatant and were subjected to electrophoresis at 120 V for 4.0 hours using a β-alanine acetic acid mixture as running buffer. The β-alanine acetic acid mixture consisted of 31.2 g of β-alanine, 8 mL of glacial acetic acid and an amount of distilled water sufficient to bring final volume to 1.0 L After the period of electrophoresis, the gel was sliced into 5 mm segments and each segment was placed in separate tubes containing 1 mL of 0.1 M potassium phosphate buffer at pH 7.0. The proteins were allowed to elute into the buffer solution for 48 hours at 4° C. One mL of gel segment elutant was added to 4 mL of the appropriate pH buffer pH 6 and pH 12 (pH 6 buffer prepared by mixing 36.85 mL of 0.1 M citric acid and 63.15 mL 0.2 M $Na_2HPO_4$ then solution titrated with 1M HCl to pH 6.0. pH 12 buffer was prepared by mixing 25 mL of 0.2 M KCl and 6.0 of 0.2 M NaOH then diluted with water to a volume of 100 mL, then solution titrated to pH 12.0) along with 0.10 g of Avicel® microcrystalline cellulose while chilling in an ice bath. The reactant mixtures were incubated with agitation at 40° C. for 1 hour. The reacting mixture was chilled in a 0° C. ice bath and filtered through a 0.45 micron filter. After incubation 800 ul of digestion mix was then added to 1.2 ml of DNS. Tubes were subjected to a boiling water bath for 10.0 min after which they were immersed in an ice water bath and 2.0 mL of deionized water was added to each tube. The absorbance of the each sample was read in spectrophotometer at 540 nm wavelength. One unit of cellulase or amylase activity (DNS method) is defined as the quantity of enzyme that liberates 1.0 micromole of reducing sugar (expressed as glucose equivalents) per minute under the standard conditions of the assay described. The absorbance value for each enzyme-containing sample was calculated by subtracting the enzyme blank value from the enzyme sample value. The net value was used to calculate the activity value from the standard glucose curve.

$$\text{Activity(Enzyme activity/gram)} = \frac{[\text{Activity value from standard curve} \times \text{dilution}]}{[\text{Micromoles glucose} \times \text{reaction time}]}$$

Gel electrophoresis separation of enzymatically active proteins expressed by *Bacillus subtilis* 6A-1 likewise confirm multiple groupings of activity on Avicel®. These data indicate that 6A-1 expresses multiple cellulase enzymes with hydrolytic activity not only on modified cellulose like CMC, but also on crystalline cellulose (Avicel®). The activity of some of the enzyme fractions appear to be active at pH 6.3 and at pH 11.12, while other(s) are predominantly active at pH 11.12.

Therefore, electrophoresis experiments (FIGS. 10, 11, 12 and 13) confirm that there is appreciable cellulase activity by more than one cellulase fraction of *Bacillus subtilis* 6A-1 and these enzyme fractions are active over the broadest of ranges in environmental pH values.

Furthermore, the sum of the data that proves the presence of more than one active cellulolytic enzyme plus the data that indicates that this catalytic activity which elicits hydrolysis of modified cellulose (like CMC), and on chemically unmodified crystalline cellulose (like Avicel®), plus the data that shows the activity extends over a very broad pH spectrum is extraordinary. These attributes provide value for *Bacillus subtilis* 6A-1 and its enzymes as they may be applied to food, feed, biochemical processes and environmental processes. Furthermore, researchers have noted a synergistic hydrolytic action on cellulose substrate when multiple cellulolytic enzymes are applied (Medve, et al— Medve J, Karlsson J, Lee D, Tjerneld F: Hydrolysis of microcrystalline cellulose by cellobiohydrolase I and endoglucanase II from *Trichoderma reesei*: adsorption, sugar production pattern, and synergism of the enzymes. *Biotechnol Bioeng*. 1998, 59: 621-634.). Therefore, *Bacillus subtilis* 6A-1 enzyme preparations offer a unique and distinct advantage.

Example 10

Protease Assessment of *Bacillus subtilis* 6A-1

Prepare the following buffer solutions.

| | Table of Buffer Solutions |
|---|---|
| pH 2 | Citric Acid-$Na_2$ $HPO_4$ Preparation: Mixed 89.1 mL of 0.1M Citric Acid and 10.90 mL of 0.2M $Na_2$ $HPO_4$ then solution titrated with 1M HCl to pH 2.0 |
| pH 4 | Citric Acid-$Na_2$ $HPO_4$ Preparation: Mixed 61.45 mL of 0.1M Citric Acid and 38.55 mL of 0.2M $Na_2$ $HPO_4$ then solution titrated with 1M HCl to pH 4.0 |
| pH 6 | Citric Acid-$Na_2$ $HPO_4$ Preparation: Mixed 36.85 mL of 0.1M Citric Acid and 63.15 mL 0.2M $Na_2$ $HPO_4$ then solution titrated with 1M HCl to pH 6.0 |
| pH 8 | $Na_2$ $HPO_4$—$NaH_2PO_4$ Preparation: Mixed 47.35 mL of 0.2M $NaH_2PO_4$ and 2.65 mL of 0.2M $Na_2$ $HPO_4$ then solution titrated with 1M HCl to pH 8.0 |
| pH 10 | $Na_2CO_3$—$NaHCO_3$ Preparation: Mixed 60 mL of 0.1M $Na_2CO_3$ and 40 mL 0.1M $NaHCO_3$ then solution titrated to pH 10.0 |
| pH 12 | KCl—NaOH Preparation: Mixed 25 mL of 0.2M KCl and 6.0 of 0.2M NaOH then diluted with water to a volume of 100 mL. Rechecked pH. |
| pH 13 | KCl—NaOH Preparation: Mixed 25 mL of 0.2M KCl and 66 mL of 0.2M NaOH then diluted with water to a volume of 100 mL. Rechecked pH. |

The experiment was completed with the following protocol. Combined 200 ul of 2% azocasein in sodium bicarbonate buffer at pH of 8.3 with 200 ul of the buffer needed to produce the required pH, and 100 ul of the *Bacillus subtilis* 6A-1 supernatant. Prepared a standard curve using neutral protease (BioCat) at 0, 20, 40, 60, 80, 100 protease units. Mixed vigorously and incubated the tube at 37° C. for 10 minutes. Placed tubes in icy cold water and added 500 ul of 20% trichloroacetic acid. Vortexed vigorously for 5 minutes. Centrifuged at 10000 rpm for 5 minutes at 4° C. Added 500 ul of supernatant to 1 ml of 1 M NaOH and read the absorbance at 440 nm. Plotted the standard curve readings on a line graph and calculated the slope and intercept of the line produced. Utilized this line to determine the number of protease units/ul/min of the *Bacillus subtilis* 6A-1 supernatant.

Figure 14:
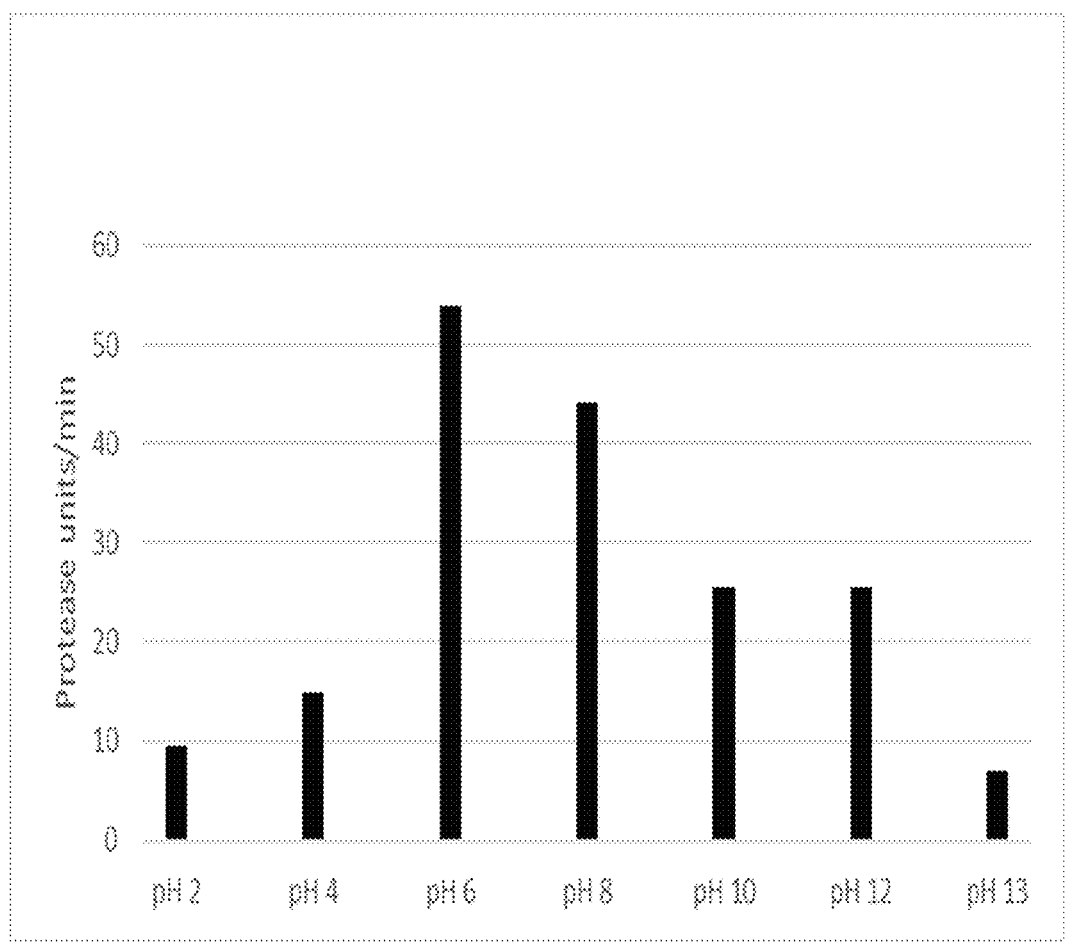
FIG. 14 is a graph showing protease activity of *Bacillus subtilis* 6A-1 supernatant at various pH levels.

The results of this experiment (FIG. 14) indicate that like carbohydrase activity *Bacillus subtilis* 6A-1 has significant protease activity at a wide range of pH levels. The particularly high activity level across pH 6 to pH 12 is especially useful in animal feed and food since it remains active in the varying pH of an animal's digestive system, and is also where used in a detergent.

Example 11

Ensilage Trials Measuring the Effect of *Bacillus subtilis* 6A-1 vs Untreated Control on Ryegrass and Alfalfa The ensilage fermentation process requires crops, grasses, legumes, and other vegetative matter to be enclosed in a relatively airtight or oxygen limiting environment. Prior to that enclosure the materials ensiled may be chopped or ground to expose surfaces of the matter and to assist in proper packing of the material. During time of the enclosure of the material, the ideal ensilage processes progresses as organic acid producing bacteria metabolize available sugars into organic acids and some alcohols (desirably lactic acid, acetic acid, and propionic acid). Organic acid development causes the pH of the ensiled material to be reduced. Preserved storage of the ensilage is possible when the pH of the material is reduced from an original pH of 6.0-7.0 to pH 4.5 or less. In order to achieve the low pH value necessary for proper storage in the quickest possible time, ensiled crops can benefit from the addition of certain enzymes, and viable bacteria (inoculants).

During the research with *Bacillus subtilis* 6A-1, it was discovered that ensiled materials can be treated beneficially from the application of the viable *Bacillus subtilis* 6A-1 (or its viable spores); by the *Bacillus subtilis* 6A-1-produced cellulolytic enzymes; or by combination of the viable *Bacillus* spp. along with its enzymes.

By inoculating ensiled materials with viable *Bacillus subtilis* 6A-1 and/or its enzymes, a more optimal preservation state may be reached. In addition, the resultant silage may contain higher level of organic fatty acids which have positive effect on butterfat production by lactating dairy cows.

The data in the Table 1 below represents a compilation of experimental data from trials in year 1 and year 2 performed upon ensiled ryegrass. Both *Bacillus subtilis* 6A-1 viable cells/spores and *Bacillus subtilis* 6A-1 enzyme containing broth extract were used to treat the ryegrass silage. Ryegrass is a forage crop that is particularly difficult to ensile commonly due to its high moisture content and possibly the low content of fermentable sugars in overly matured stage of growth. It is very important that pH levels in the ensiled crop drops rapidly to a low level to ensure optimal storage condition. Procedures for the experimental process are found below, along with an interpretation of the data. TMT refers to Total Mixed Ration (60% Corn, 25% SBM (Soy Bean Meal).

TABLE 1

Ryegrass Ensilage Trials

| TMT | % Lactic acid | % Acetic Acid | % Mannitol | pH |
|---|---|---|---|---|
| Control[3] | 11.21 | 2.91$^a$ | 1.93$^a$ | 3.96$^a$ |
| 6A-1[3] | 11.01 | 2.51$^b$ | 2.77$^b$ | 3.76$^b$ |
| Control[4] | 10.66 | 2.24a | 0.08$^a$ | 4.22 |
| 6A-1 extract[4] | 10.88 | 1.79b | 0.23$^b$ | 4.19 |

| TMT | % DM[1] loss | % DMD[2] 8 h | Ammonia-N$_{ppm}$ | Yeast* |
|---|---|---|---|---|
| Control[3] | 3.74$^a$ | 35.39$^a$ | 3064$^a$ | 251$^a$ |
| 6A-1[3] | 2.69$^b$ | 39.25$^b$ | 2904$^b$ | 33$^b$ |
| Control[4] | 2.55 | 55.29 | 3235 | 20893$^a$ |
| 6A-1 extract[4] | 2.44 | 56.37 | 3051 | 3388$^b$ |

Superscript a and b values represent data points which vary by statistically significant amount ($P < 0.05$).
[1]Dry Matter Loss (DM Loss) is a measure of the loss of dry weight of the ensiled material lost during the ensiling fermentation. See definition below.
[2]DMD (Dry Matter Digestibility or Dry Matter Disappearance) is a measure of the resultant digestibility of the feedstuffs in the animal or under animal-like conditions. The DMD is measured by taking a standard quantity of the dried substrate, placing it in the solution according to the procedure described below that aids in the digestion of feedstuffs. See definition below.
[3]Year 1
[4]Year 2
*Represents yeast count in CFU/g-.

In year 1, *Bacillus subtilis* 6A-1 viable bacteria only were used to treat ensiled crop to determine effects of *Bacillus subtilis* 6A-1 as a silage inoculant. Viable cells of 6A-1 were dosed at approximately 100,000 cfu/g (Colony Forming Units/gram) of the forage which was treated. In year 2, *Bacillus subtilis* 6A-1 enzyme broth was separated from the viable *Bacillus subtilis* 6A-1 viable cells and spores by filtration with 0.45 μm filter, and this process yielded a bacteria-free broth extract at an estimated enzymatic concentration described as follows: 68 ml of 6A-1 broth with an activity level of 0.4 DNS enzyme units per ml was added into 30 pounds of chopped ryegrass, mixed and placed into the silos made up of PVC pipe, and the whole contents were weighed and recorded as initial weight. The contents were allowed to ferment for 33 days. After 33 days, silos were weighed and the Dry Matter (DM) loss percentage was calculated for each silo by determining the difference between the initial and final weight of the silos and dividing that by the initial weight and multiplying by 100. Silos were opened and representative portions representing approximately 300 grams (as sampled basis) of the fermented forage were obtained and processed for the following values: pH, % Volatile Fatty Acids (VFA) by Capillary Electrophoresis. Capillary Electrophoresis (CE) is an analytical tool which permits rapid and efficient separations of charged organic acid components present in small sample volumes. Clean separations of these organic acids are based on the differences in electrophoretic motilities of ions in electrophoretic media inside small capillaries. In year 1, ryegrass was harvested at high moisture and ensiled the same day. In year 2, the ryegrass was allowed to wilt for 24 hours.

An 8 hour in vitro Dry Matter Digestibility (DMD) was performed on the samples by placing 1.0 g of sample combined with DMD solution (Solution A: $CaCl_2$ $2H_2O$ 0.1 g/L, $MgSO_4$ $7H_2O$ 0.5 g/L, NaCl 0.5 g/L, Urea 0.5 g/L and $KH_2PO_4$ 10 g/L and Solution B:$Na_2S$ $9H_2O$ 0.4 g/L, $Na_2CO_3$ 6.0 g/L). The following protocol was used in the experiment. Solution B was added to Solution A until pH of 6.8 is reached). This mixture was allowed to incubate for 8 hours at 39° C. The contents were filtered through a very finely porous glass crucible, the residual material was washed several times with distilled or deionized water, and the residual content was dried at 100° C. for 6 hours. The difference between the original dry weight and the residual dry weight divided by the original dry weight multiplied by 100 is considered as the percentage of dry matter disappeared or Digestible Dry Matter (DMD). The higher the DMD, the higher the percentage of nutrients that may be "digestible" or available to animals; higher DMD results in positive production conditions.

Other analytical procedures were performed to assess the performance of silage treatments, Ammonia-N(Ammonia Nitrogen concentration), Mannitol [% concentration] and Yeast Viable Count-CFU/g (CFU/g was measured on an as-sampled basis).

The data in Table 1 shows a definite improvement in ryegrass silage (often called ryelage or haylage) treated with 6A-1 over the untreated control lot of silage. The positive effects were somewhat more noticeable in year 1 than in year 2. More acetate (acetic acid) produced during an ensilage fermentation is indicative of a more heterofermentation (fermentation by heterofermentative lactic acid-forming bacteria), rather than a homofermentation which is usually judged to yield silage of higher nutritional quality. A heterofermentation could lead to more inefficient energy conservation due to loss of more $CO_2$ during the ensilage fermentation ($CO_2$ loss accompanies production of acetic acid). Acetic acid or acetate may actually be good for silage bunk life, but excessive concentration in the silage is detrimental to silage intake by ruminants. There was significantly less acetic acid formed during the ryegrass fermentation when Bacillus subtilis 6A-1 viable cells or 6A-1 enzyme-containing broth was added at time of ensiling.

It is always positive to have a lower pH level at the end of grass or hay-type ensilage fermentation since lower pH levels will prevent spoilage caused by yeast and mold, There were lower pH levels attained with both 6A-1 treatments of the silage; statistically the pH was lowered significantly when viable Bacillus subtilis 6A-1 was added to the ensilage as an inoculant.

The Bacillus subtilis 6A-1 viable cells significantly depressed viable yeast content in the finished silage for the year 1 (this is a great advantage for silage stability).

Ammonia concentrations were numerically lower in both years with both 6A-1 treatment types (significantly so for year 1 when the viable 6A-1 was used as a viable inoculant). These results indicate that 6A-1 prevented conversion of plant protein into inefficient and potentially toxic ammonia. Ammonia is the result of breakdown of amino acids in proteins releasing the ammonium moiety. Protein conservation during the ensilage fermentation is essential for preserving and yielding a high nutritional quality end product.

There were increases in in vitro Dry Matter Digestibilities (DMD) both years in the 6A-1 treated haylage. It is likely that 6A-1 enzymes pre-digest nutrients while the ensiling process continues. Analysis to determine Dry Matter Loss indicated that the 6A-1 treated silos in both years of experimentation experience less loss of dry matter during the ensiling process.

An alfalfa ensiling trial was executed in the same manner as described above, except that the forage used in the trial was alfalfa instead of ryegrass and Bacillus subtilis 6A-1 enzyme broth separated from viable cells was used as above. Alfalfa represents a particularly valuable forage crop, having high protein content. However, alfalfa is also typically difficult to ensile in optimal manner. The buffering capability of the plant contents, and low fermentable sugars found in the crop result in silages which have only moderately reduced pH and relatively low content of lactic acid. This phenomenon results in the potential deterioration of alfalfa silages and unsatisfactory stability under typical storage conditions. Treatment of alfalfa with Bacillus subtilis 6A-1 using dry inoculant at the rate of 2 DNS units/kilogram of silage, as in the ensiling trial describe above, resulted in statistically better quality resultant silage. These results are reported in the table below:

TABLE 2

| | Alfalfa Ensiling Trial | | | | |
|---|---|---|---|---|---|
| TMT | Initial pH | Final pH | Initial % Lactic Acid | Final % Lactic Acid | % Dry Matter Loss |
| Control | 5.92 | $4.333^a$ | 0.127 | $4.95^a$ | $0.872^a$ |
| 6A-1 Treated | 5.92 | $4.223^b$ | 0.127 | $6.94^b$ | $0.840^b$ |

Superscripts $a$ and $b$ beside values indicate that the values are statistically different from one another.

Viable Bacillus subtilis 6A-1, when used as an inoculant, as well as the 6A-1 enzyme treatment reduced Dry Matter loss normally experienced during ensilage fermentations. Conservation of dry matter during the ensiling process is a measure of the efficiency of the fermentative ensiling process and increased Dry Matter conservation during ensiling represents a great economic benefit to farmers because it means lower feed cost and less wastage of nutrients.

In summary, the treatment of ensiled crops either with viable Bacillus subtilis 6A-1 or with Bacillus subtilis 6A-1 enzymes at time of ensiling results in a higher quality silage at the completion of fermentation. At the end of fermentation the pH of the environment increases to the point the bacteria cannot survive.

Example 12

In Vitro and In Vivo Studies of Effects of Bacillus subtilis 6A-1 on Rumen Digestion To determine the effects of directly feeding Bacillus subtilis 6A-1 to ruminants, an in vitro digestibility study of ruminant ration and ration components with and without *Bacillus subtilis* 6A-1 viable cells and/or enzymes was performed. *Bacillus subtilis* 6A-1 cells and spores were separated from the strain's enzymes by standard techniques of centrifugation or centrifugation followed by filtration through a 0.45 micron filter. The enzyme-containing liquid from the bacterial fermentation forms the supernatant which can be decanted achieving separation from *Bacillus subtilis* 6A-1 cells and spores. Filtration further refines the enzyme extract. This separation technique is offered as example only. Enzyme separation and purification and even concentration may be accomplished by other known technologies including but not limited to: simple membrane filtration, ultrafiltration, tangential flow technique, differential precipitation, and others.

The enzyme extract was added to an in vitro continuously operating rumen apparatus. This apparatus has been shown to mimic results obtained from addition of ingredients, and additives in vivo (in fistulated and unfistulated ruminating cattle). Digestion of fiber was enabled to higher degree in the in vitro rumen as well. Positive effects in vitro are translated into achieving more efficient feed digestion in ruminants. A *Bacillus subtilis* 6A-1 preparation produced for optimal enzyme production was added to similar apparatus along with the enzymes it produced.

Table 3 and 4 represent a compilation of data obtained from in vitro digestibility utilizing a series of 0.25 gram samples of Corn Silage, TMR, and Hay samples were placed into in vitro tubes containing buffer at pH 6.5. TMR refers to Total Mixed Ration and the components of the ration vary depending upon the animal that will be fed and the crops and feed available. Composition of the TMR here used is described below. Approximately 20 μL of *Bacillus subtilis* 6A-1 broth was added to each tube and the tubes containing the buffer previously described were incubated at 39.5° C. for 16 hours to measure any improvements in digestibility of given feedstuffs obtained with the addition of *Bacillus subtilis* 6A-1 fermentation products (broth, viable cells, and/or enzyme containing broth extract) versus digestibilities noted with untreated control samples. The liquid *Bacillus subtilis* 6A-1 culture was added at a comparative rate of 80 mL/head/day. In every trial *Bacillus subtilis* 6A-1 fermentation products elicited an improvement in digestibility over the untreated lots. These data indicate that the use of *Bacillus subtilis* 6A-1 in ruminant livestock diets can be expected to improve digestibility of representative rations and feedstuffs fed the animal. Increasing efficiency of digestibility is directly related to improving economic value in feeding livestock.

TABLE 3

In Vitro Digestibility[1] of Ruminant Ration and Ration Components With and Without *Bacillus subtilis* 6A-1 Viable Cells and/or Enzymes

| Type of Sample | Hours of Incubation | Control No 6A-1 | 6A-1 Broth | 6A-1 Viable Cells | 6A-1 Enzymes |
|---|---|---|---|---|---|
| Corn Silage 1 | 24 | 60.8 | 67.36 | | |
| Corn Silage 2 | 12 | 55.08 | | 56.32 | |
| Corn Silage 3 | 24 | 64.89 | | 66.8 | |
| Hay | 16 | 55.2 | | | 56.71 |
| Total Mixed Ration[2] (TMR) | 16 | 56.56 | | 58.2 | 59.24 |

[1]All Digestibility values are in %. The difference between the final and initial weight of the TMR sample divided by the initial weight and multiplied by 100 yielded the digestibility values.
[2]The composition of the TMR was follows: 60% CS, 15% Alfalfa Haylage, 15% Corn, and 10% SBM)

Volatile Fatty Acid (VFA) development in the rumen of livestock is an indicator of the manner in which the hydrolyzed sugars are fermented so as to enable them to be absorbed for efficient animal assimilation. Furthermore, there is a positive relationship between VFA development, energy produced from a fed animal ration, and in lactating cattle, the butterfat produced in milk yielded. The total VFA values measured for 6A-1 treatments showed an appreciably increased value for total VFA produced over the Control. Expressed on an as-is basis, the 6A-1 group of treatments show increases in total VFA development from the rations.

All of these factors are positive, and indicate that the addition of *Bacillus subtilis* 6A-1 can have positive nutritional effects on the digestion of feedstuffs in ruminants.

TABLE 4

In Vitro Analysis[1] of Ruminant Rations for Volatile Fatty Acid Development With and Without Treatment with *Bacillus subtilis* 6A-1 Viable Cell and Enzyme

| Type of Sample | VFA[2] Types | Control No 6A-1[3] | 6A-1 Viable Cells | 6A-1 Enzymes |
|---|---|---|---|---|
| Hay | Acetate | 57.34 | 57.91 | 57.57 |
| | Propionate | 25.66 | 24.72 | 24.64 |
| | Sum VFA (μM/mL) | 51.43 | 69.2 | 73.2 |
| Total Mixed Ration[4] (TMR) | Acetate | 54.54 | 55.99 | 53.14 |
| | Propionate | 31.66 | 30.9 | 31.58 |
| | Sum VFA (μM/mL) | 51.96 | 59.54 | 60.62 |

[1]See procedure for in vitro analysis and VFA analysis: IVDMD, Tilley, J. M. A. and R. A. Terry. 1963. A two stage technique for the in vitro digestion of forage crops. *J. Brit. Grassl. Soc.* 8: 104. For VFA, Erwin, E. S., G. J. Marco and E. M. Emory. 1961. Volatile fatty acid analysis of blood and rumen fluid by gas chromatography. *J. Dairy Sci.* 44: 1768
[2]VFA = Volatile Fatty Acid
[3]All VFA values are in moles/100 mL
[4]The composition of the TMR was as follows: 60% CS, 15% Alfalfa Haylage, 15% Corn, and 10% SBM)

The effect of *Bacillus subtilis* 6A-1 on ruminant and swine rations were assessed in the following manner. A 1.0 gram sample of the Total Mixed Ration (60% Corn, 25% SBM (Soy Bean Meal) and 10% DDG (Dried Distiller's Grains)) was incubated at 39.5° C. with 120 mL of each buffer (buffer solutions found in Enzyme Activity in Polysaccharides) at the recorded pH, and 0.1 g of *Bacillus subtilis* 6A-1 culture produced upon semi-solid substrate was added. Incubation of the enzyme-bearing culture of *Bacillus subtilis* 6A-1 with the rations specified was arrested after 60 minutes by immersion in a 0° C. ice bath. The sample was filtered through 0.45 micron filter and the filtered liquid was subjected to cellulase activity assay (found in Cellulase and Amylase enzyme Activity Determination) to measure the sugars liberated from the rations.

Figure 15:
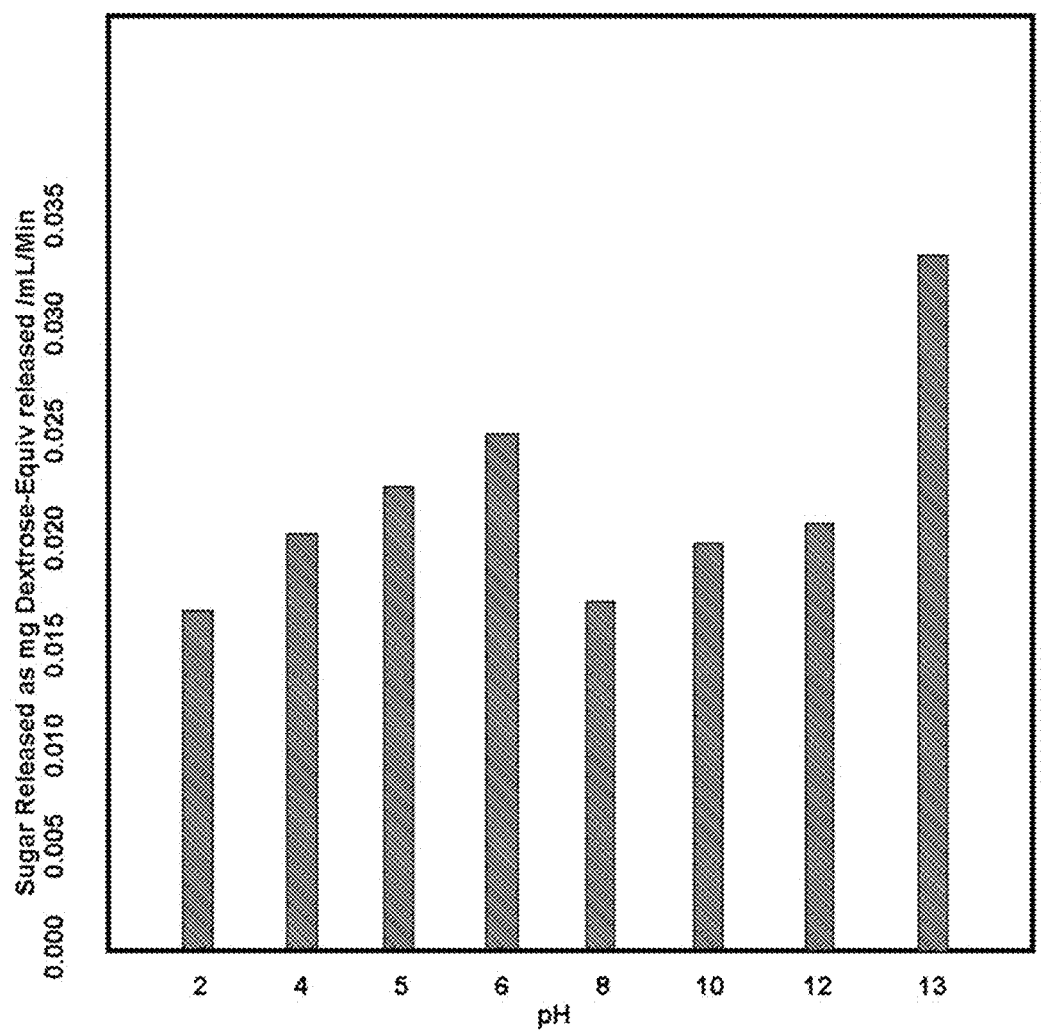
FIG. 15 is a graph showing sugars released from Dried Distillers Grain based swine ration as a result of treatment with 50 μL of *Bacillus subtilis* 6A-1 enzyme-containing broth.

The information in FIG. 15 is from incubating *Bacillus subtilis* 6A-1 enzyme containing broth at 50 μL level with Swine-type diet containing 60% Corn, 25% SBM (Soy Bean Meal) and 10% DDG (Dried Distiller's Grains). These results indicate that 6A-1 is effective in digesting a typical swine-type ration over the very broad pH range of 2-13.

Figure 16:
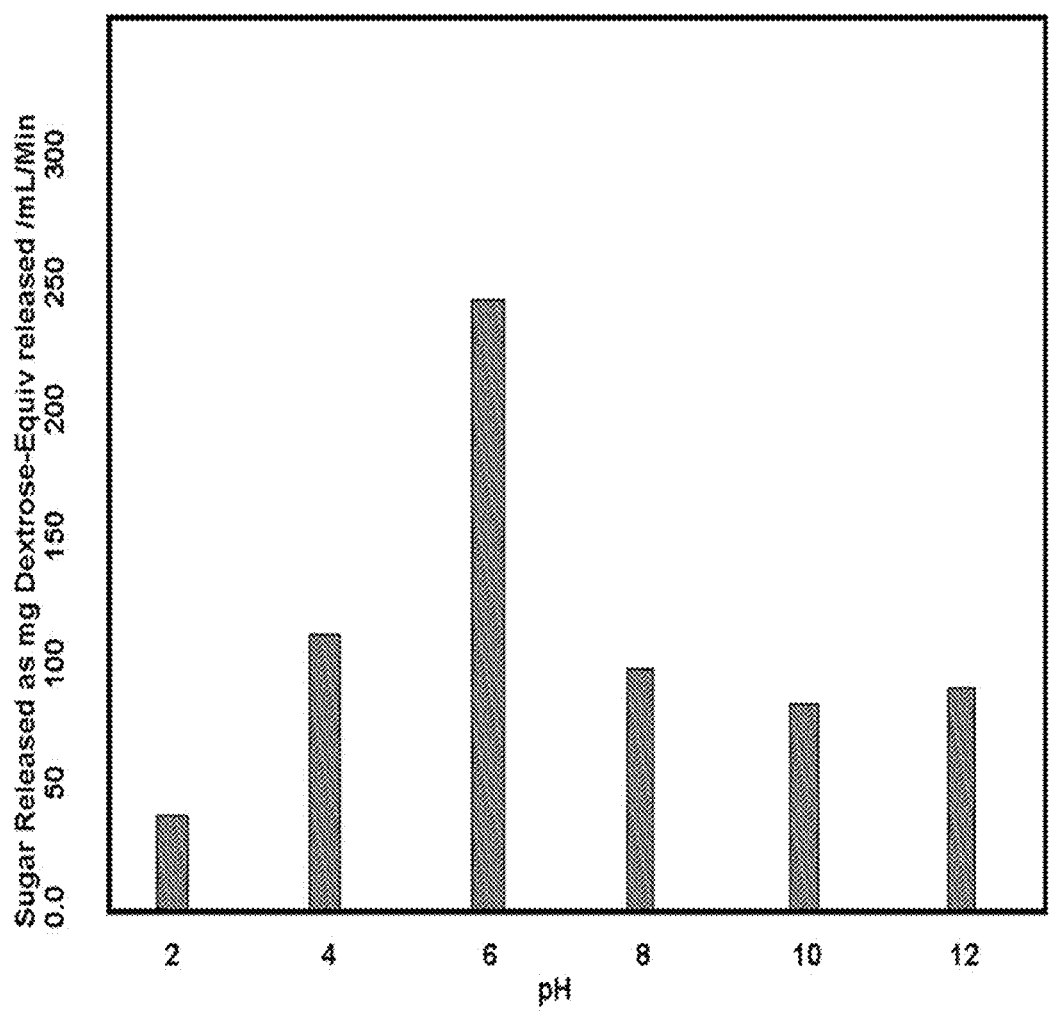
FIG. 16 is a graph showing sugars released from Total Mixed Ration—fed ruminants as a result of treatment with *Bacillus subtilis* 6A-1 enzyme-containing SSWM at various pH levels.

The FIG. 16 represents the use of *Bacillus subtilis* 6A-1 enzyme-containing fermentation product, produced by semi-solid culturing method. The method for production is described below. The enzyme-containing material was added to a ration suitable for a ruminant type diet. A total mixed ration (TMR) was utilized. This typical TMR contained corn silage, alfalfa haylage, ground corn and mineral supplement. These results indicate that 6A-1 is effective in digesting a typical ruminant-type ration over the very broad pH range of 3-12.

Semi-solid fermentation production of *Bacillus subtilis* 6A-1 enzyme and viable cell containing fermentation product was produced in the following manner. 800 ml of distilled water was added to 1000 g of Wheat Bran (from Bob's Red Mill) along with 200 ml of 0.1 M potassium pH 7.0 phosphate buffer. In the liquid addition was suspended or dissolved: 20 g $CaCO_3$, 41 g $CaCl_2$ dihydrate and 6.29 g $MnCl_2*4H_2O$. The moistened bran mixture was spread into 9×13 inch trays and covered with aluminum foil. The trays were autoclaved for 15 min at 121° C. and 15 psi.

The semi-solid medium so prepared was cooled to less than 40° C. and was inoculated with 35 ml of vegetative *Bacillus subtilis* 6A-1 broth (prepared as above) and incubated at 37° C. for 24 hours. The semi-solid fermentation product thus prepared was then dried 18 hours at 54° C. to less than 15% moisture. The resulting dry material was utilized in the animal feeding trial and in results reported as semi-solid wheat media or SSWM.

Dry semi-solid product of *Bacillus subtilis* 6A-1 (SSWM) was rehydrated (1 g in 50 ml of distilled $H_2O$) and held at room temperature for 10 min. The rehydrated mixture was filtered using 3 layers of cheesecloth then the filtrate was further filtered through a 0.45μ filter. The 6A-1 aqueous extract was then used in studies which specify the use of *Bacillus subtilis* 6A-1 semi-solid material either in dry granular form or in aqueous extracted form.

In vitro research has been supported by in vivo feeding trials which further prove the efficacy of *Bacillus subtilis* 6A-1 addition to diets of livestock. In the table below data is reported for the dry matter digestibility (DMD) from a trial using 12 lambs per treatment averaging 28 pounds each in weight. All groups were fed a Total Mixed Ration (TMR) composed of corn silage, haylage, and minerals/vitamin supplement. The animals were placed in collection crates for a 3 day adjustment period prior to the beginning of the trial. All animals had been exposed to the basal TMR diet used for more than 30 days.

Approximately, 1.0 gram of *Bacillus subtilis* 6A-1 produced by the semi-solid production method described above was fed after the mixture was ground through 4 mm screen to allow homogeneous sampling of the 6A-1 preparation. The 1.0 gram of 6A-1 preparation was mixed into the TMR thoroughly, and specific amounts were fed twice a day to each animal. All animals were fed ad libitum to prevent any limitation that may skew natural intake tendencies.

Feed, feed refusals and fecal samples were collected during the five day collection. Samples were frozen until the end of trial, then analyzed. The amount of feed (wet weight) fed, the feed refused and the amount of wet fecal weights were recorded daily during the collection period, and these weights were converted to dry weights after determining the dry matter contents of each sample.

Analysis of the residual waste from the sheep-fed trial was performed and compared to quantitative amounts of original ration ingested during the trial described above. The feeding trial yielded data which is reported in the table below (all values stated are in %):

TABLE 5

Residual Waste Analysis of In Vivo Sheep fed *Bacillus subtilis* 6A-1

| | Dry Matter (in vivo)[1] Digestibility | Neutral Det. Fiber[2] Digestibility | ADF[3] Digestibility | Hemicellulose[4] Digestibility |
|---|---|---|---|---|
| Control | 65.3 | 40.4 | 36.1 | 46.43 |
| 6A-1 Treated | 66.19 | 44.29 | 40.99 | 48.99 |

[1]The percent Dry Matter Digestibility (DMD) in vivo was calculated by subtracting from Total Dry Feed fed/day the total dry feed refused (which was the Actual Feed Intake) minus total dry fecal weights. The value obtained was divided by the Actual Feed Intake multiplied by 100.
[2]The percentage Neutral Detergent Fiber (NDF) Digestibility was determined by comparing ingested feed with analysis of the manure collected in similar fashion to that calculation for Total Dry Matter Digestibility reported above (In determining NDF values, a neutral detergent solution is used to dissolve the easily digested pectins and plant cell contents (proteins, sugars, and lipids); leaving a fibrous residue (aNDF) that is primarily cell wall components of plants (cellulose, hemicellulose, and lignin). Detergent is used to solubilize the proteins and sodium sulfite also helps remove some nitrogenous matter; EDTA is used to chelate calcium and remove pectins at boiling temperatures; triethylene glycol helps to remove some non-fibrous matter from concentrate feeds; and heat-stable amylase is used to remove starch. Two additions of amylase (one during refluxing and one during filtration) have been observed to aid NDF analyses and minimize filtering difficulties. Heat-stable amylases are used in hot solutions to inactivate potential contaminating enzymes that might degrade fibrous constituents (AOAC Official Method 2002.04 Amylase-Treated Neutral Detergent Fiber in Feeds). NDF is the most common measure of fiber used for animal feed analysis, but it does not represent a unique class of chemical compounds. NDF measures most of the structural components in plant cells (e.g. lignin, hemicellulose and cellulose).
[3]The percentage Acid Detergent Fiber (ADF) Digestibility was determined by comparing ingested feed with the analysis of the manure collected in similar fashion to that calculation for Total Dry Matter Digestibility reported above. Values for ADF were determined by the ADF methodology outlined above.
[4]The percentage Hemicellulose Digestibility was determined by comparing ingested feed with the analysis of the manure collected in similar fashion to that calculation for Total Dry Matter Digestibility reported above. Hemicellulose content is defined as the residue extracted when an NDF residue is subjected to boiling Acid Detergent Solution (as specified in the ADF procedure) for one hour. (% NDF − % ADF = % Hemicellulose)

Higher comparative DMD values in a feeding trial with variations in feed would describe a situation where the test animal(s) are able to digest and assimilate feed to a comparatively greater degree. Thus comparatively higher DMD values in a feeding trial are desirable and indicate that a feed composition has higher degree of feeding value. DMD for the treated feed was appreciably higher than for the Control feeds. This provides for more efficient feeding for the livestock producer who uses *Bacillus subtilis* 6A-1 preparations mixed in feed.

In a livestock feeding program, efforts are made to increase the Dry Matter Digestibility of feed, and more recently greater efforts are concentrated in achieving better digestibility of the fiber portions of the feed such as NDF, ADF, and Hemicellulose. The higher the values, the better the efficiency of dry matter intake, healthy rumen functions with ruminants, and optimized milk components such as percent milk butter fat and percent milk proteins.

SEQUENCE LISTING (1 sequence)

SEQ ID NO: 1 - DNA, 4215304 bp, Bacillus subtilis (residues 1-1,405,102 of 4,215,304)
  modified_base (92206)..(92221): a, c, t, g, unknown or other
  modified_base (97963)..(98077): a, c, t, g, unknown or other
  modified_base (161668)..(161668): a, c, t, g, unknown or other
  modified_base (163248)..(163248): a, c, t, g, unknown or other
  modified_base (164867)..(164902): a, c, t, g, unknown or other
  modified_base (165555)..(165555): a, c, t, g, unknown or other
  modified_base (166792)..(166850): a, c, t, g, unknown or other
  modified_base (169385)..(169388): a, c, t, g, unknown or other
  modified_base (169844)..(169871): a, c, t, g, unknown or other
  modified_base (169967)..(170068): a, c, t, g, unknown or other
  modified_base (176583)..(176757): a, c, t, g, unknown or other
  modified_base (213087)..(222931): a, c, t, g, unknown or other
  modified_base (238257)..(241912): a, c, t, g, unknown or other
  modified_base (243779)..(243810): a, c, t, g, unknown or other
  modified_base (365852)..(365868): a, c, t, g, unknown or other
  modified_base (369250)..(369360): a, c, t, g, unknown or other
  modified_base (370126)..(370143): a, c, t, g, unknown or other
  modified_base (386201)..(386250): a, c, t, g, unknown or other
  modified_base (396473)..(396478): a, c, t, g, unknown or other
  modified_base (490531)..(490551): a, c, t, g, unknown or other
  modified_base (490575)..(490698): a, c, t, g, unknown or other
  modified_base (514754)..(514801): a, c, t, g, unknown or other
  modified_base (524279)..(525644): a, c, t, g, unknown or other
  modified_base (529533)..(549829): a, c, t, g, unknown or other
  modified_base (550104)..(551209): a, c, t, g, unknown or other
  modified_base (551244)..(556201): a, c, t, g, unknown or other
  modified_base (560780)..(560792): a, c, t, g, unknown or other
  modified_base (561459)..(561473): a, c, t, g, unknown or other
  modified_base (570109)..(570145): a, c, t, g, unknown or other
  modified_base (585089)..(585108): a, c, t, g, unknown or other
  modified_base (591905)..(593378): a, c, t, g, unknown or other
  modified_base (602793)..(602794): a, c, t, g, unknown or other
  modified_base (621595)..(621633): a, c, t, g, unknown or other
  modified_base (635497)..(635503): a, c, t, g, unknown or other
  modified_base (651867)..(663181): a, c, t, g, unknown or other
  modified_base (663330)..(663389): a, c, t, g, unknown or other
  modified_base (663564)..(663732): a, c, t, g, unknown or other
  modified_base (663917)..(664144): a, c, t, g, unknown or other
  modified_base (694261)..(694347): a, c, t, g, unknown or other
  modified_base (737336)..(737349): a, c, t, g, unknown or other
  modified_base (738952)..(746110): a, c, t, g, unknown or other
  modified_base (746561)..(748678): a, c, t, g, unknown or other
  modified_base (749652)..(749847): a, c, t, g, unknown or other
  modified_base (773989)..(774088): a, c, t, g, unknown or other
  modified_base (813833)..(814047): a, c, t, g, unknown or other
  modified_base (818883)..(822860): a, c, t, g, unknown or other
  modified_base (846232)..(846331): a, c, t, g, unknown or other
  modified_base (846389)..(846405): a, c, t, g, unknown or other
  modified_base (846459)..(848931): a, c, t, g, unknown or other
  modified_base (849066)..(849644): a, c, t, g, unknown or other
  modified_base (849721)..(849958): a, c, t, g, unknown or other
  modified_base (886720)..(886732): a, c, t, g, unknown or other
  modified_base (886908)..(887338): a, c, t, g, unknown or other
  modified_base (887723)..(887730): a, c, t, g, unknown or other
  modified_base (888387)..(888413): a, c, t, g, unknown or other
  modified_base (893756)..(893836): a, c, t, g, unknown or other
  modified_base (910650)..(910657): a, c, t, g, unknown or other
  modified_base (957592)..(959190): a, c, t, g, unknown or other
  modified_base (1124971)..(1125053): a, c, t, g, unknown or other
  modified_base (1159006)..(1159788): a, c, t, g, unknown or other
  modified_base (1160021)..(1160111): a, c, t, g, unknown or other
  modified_base (1160336)..(1160360): a, c, t, g, unknown or other
  modified_base (1213855)..(1214035): a, c, t, g, unknown or other
  modified_base (1214270)..(1214340): a, c, t, g, unknown or other
  modified_base (1214394)..(1214475): a, c, t, g, unknown or other
  modified_base (1214706)..(1215224): a, c, t, g, unknown or other
  modified_base (1215253)..(1215683): a, c, t, g, unknown or other
  modified_base (1216102)..(1216615): a, c, t, g, unknown or other
  modified_base (1250589)..(1251919): a, c, t, g, unknown or other
  modified_base (1262865)..(1264966): a, c, t, g, unknown or other
  modified_base (1265298)..(1267330): a, c, t, g, unknown or other
  modified_base (1267560)..(1267954): a, c, t, g, unknown or other
  modified_base (1268106)..(1268168): a, c, t, g, unknown or other
  modified_base (1268546)..(1269906): a, c, t, g, unknown or other
  modified_base (1270089)..(1270395): a, c, t, g, unknown or other
  modified_base (1278382)..(1278434): a, c, t, g, unknown or other
  modified_base (1289481)..(1289868): a, c, t, g, unknown or other
  modified_base (1334747)..(1335429): a, c, t, g, unknown or other
  modified_base (1335454)..(1336083): a, c, t, g, unknown or other
  modified_base (1336133)..(1336687): a, c, t, g, unknown or other
  modified_base (1336722)..(1337208): a, c, t, g, unknown or other
  modified_base (1338160)..(1338166): a, c, t, g, unknown or other
  modified_base (1338905)..(1338974): a, c, t, g, unknown or other
  modified_base (1344625)..(1344673): a, c, t, g, unknown or other
  modified_base (1344851)..(1345162): a, c, t, g, unknown or other
  modified_base (1353976)..(1354033): a, c, t, g, unknown or other
  modified_base (1441803)..(1441883): a, c, t, g, unknown or other
  modified_base (1443757)..(1445742): a, c, t, g, unknown or other
  modified_base (1445953)..(1446019): a, c, t, g, unknown or other
  modified_base (1478759)..(1482128): a, c, t, g, unknown or other
  modified_base (1539711)..(1539923): a, c, t, g, unknown or other
  modified_base (1780148)..(1780194): a, c, t, g, unknown or other
  modified_base (1782427)..(1859858): a, c, t, g, unknown or other
  modified_base (1879742)..(1879805): a, c, t, g, unknown or other
  modified_base (1882890)..(1882908): a, c, t, g, unknown or other
  modified_base (1883610)..(1884143): a, c, t, g, unknown or other
  modified_base (1886487)..(1886898): a, c, t, g, unknown or other
  modified_base (1909077)..(1910736): a, c, t, g, unknown or other
  modified_base (1945675)..(1945794): a, c, t, g, unknown or other
  modified_base (1946016)..(1946048): a, c, t, g, unknown or other
  modified_base (1967676)..(1967749): a, c, t, g, unknown or other
  modified_base (1968097)..(1968135): a, c, t, g, unknown or other
  modified_base (1968602)..(1968797): a, c, t, g, unknown or other
  modified_base (1969275)..(1978433): a, c, t, g, unknown or other
  modified_base (1978583)..(1978683): a, c, t, g, unknown or other
  modified_base (1979386)..(1979388): a, c, t, g, unknown or other
  modified_base (1979641)..(1979668): a, c, t, g, unknown or other
  modified_base (1979831)..(1979920): a, c, t, g, unknown or other
  modified_base (1980621)..(1980710): a, c, t, g, unknown or other
  modified_base (1981045)..(1993707): a, c, t, g, unknown or other
  modified_base (1995858)..(1995890): a, c, t, g, unknown or other
  modified_base (1996287)..(1996287): a, c, t, g, unknown or other
  modified_base (2027715)..(2028687): a, c, t, g, unknown or other
  modified_base (2037074)..(2038174): a, c, t, g, unknown or other
  modified_base (2039658)..(2040893): a, c, t, g, unknown or other
  modified_base (2049569)..(2049598): a, c, t, g, unknown or other
  modified_base (2050204)..(2050458): a, c, t, g, unknown or other
  modified_base (2050876)..(2050962): a, c, t, g, unknown or other
  modified_base (2056215)..(2057053): a, c, t, g, unknown or other
  modified_base (2057504)..(2057704): a, c, t, g, unknown or other
  modified_base (2057977)..(2061004): a, c, t, g, unknown or other
  modified_base (2061069)..(2061109): a, c, t, g, unknown or other
  modified_base (2061917)..(2061991): a, c, t, g, unknown or other
  modified_base (2062054)..(2062136): a, c, t, g, unknown or other
  modified_base (2062213)..(2063361): a, c, t, g, unknown or other
  modified_base (2064279)..(2064821): a, c, t, g, unknown or other
  modified_base (2065010)..(2069122): a, c, t, g, unknown or other
  modified_base (2069993)..(2071142): a, c, t, g, unknown or other
  modified_base (2075663)..(2078921): a, c, t, g, unknown or other
  modified_base (2151912)..(2161333): a, c, t, g, unknown or other
  modified_base (2161641)..(2191352): a, c, t, g, unknown or other
  modified_base (2191461)..(2191521): a, c, t, g, unknown or other
  modified_base (2191794)..(2193454): a, c, t, g, unknown or other
  modified_base (2193510)..(2194761): a, c, t, g, unknown or other
  modified_base (2194831)..(2194931): a, c, t, g, unknown or other
  modified_base (2195061)..(2211746): a, c, t, g, unknown or other
  modified_base (2213328)..(2214758): a, c, t, g, unknown or other
  modified_base (2215081)..(2221766): a, c, t, g, unknown or other
  modified_base (2221973)..(2246613): a, c, t, g, unknown or other
  modified_base (2246878)..(2246914): a, c, t, g, unknown or other
  modified_base (2247129)..(2247138): a, c, t, g, unknown or other
  modified_base (2247192)..(2247307): a, c, t, g, unknown or other
  modified_base (2247474)..(2247701): a, c, t, g, unknown or other
  modified_base (2247770)..(2255291): a, c, t, g, unknown or other
  modified_base (2255565)..(2264541): a, c, t, g, unknown or other
  modified_base (2264765)..(2270278): a, c, t, g, unknown or other
  modified_base (2270875)..(2270910): a, c, t, g, unknown or other
  modified_base (2271888)..(2271967): a, c, t, g, unknown or other
  modified_base (2272216)..(2272245): a, c, t, g, unknown or other
  modified_base (2272442)..(2273767): a, c, t, g, unknown or other
  modified_base (2275053)..(2275966): a, c, t, g, unknown or other
  modified_base (2276174)..(2276429): a, c, t, g, unknown or other
  modified_base (2277292)..(2277723): a, c, t, g, unknown or other
  modified_base (2277953)..(2280210): a, c, t, g, unknown or other
  modified_base (2280358)..(2286286): a, c, t, g, unknown or other
  modified_base (2296986)..(2297716): a, c, t, g, unknown or other
  modified_base (2433445)..(2434763): a, c, t, g, unknown or other
  modified_base (2466339)..(2466397): a, c, t, g, unknown or other
  modified_base (2587391)..(2588404): a, c, t, g, unknown or other
  modified_base (2663114)..(2664405): a, c, t, g, unknown or other
  modified_base (2667354)..(2667525): a, c, t, g, unknown or other
  modified_base (2701673)..(2701904): a, c, t, g, unknown or other
  modified_base (2702230)..(2715662): a, c, t, g, unknown or other
  modified_base (2725101)..(2726926): a, c, t, g, unknown or other
  modified_base (2732600)..(2732622): a, c, t, g, unknown or other
  modified_base (2743833)..(2747775): a, c, t, g, unknown or other
  modified_base (2897976)..(2897977): a, c, t, g, unknown or other
  modified_base (2898039)..(2898063): a, c, t, g, unknown or other
  modified_base (3116006)..(3116306): a, c, t, g, unknown or other
  modified_base (3116585)..(3116685): a, c, t, g, unknown or other
  modified_base (3173804)..(3173804): a, c, t, g, unknown or other
  modified_base (3177930)..(3177933): a, c, t, g, unknown or other
  modified_base (3254022)..(3254291): a, c, t, g, unknown or other
  modified_base (3254466)..(3256586): a, c, t, g, unknown or other
  modified_base (3267586)..(3267940): a, c, t, g, unknown or other
  modified_base (3268039)..(3268364): a, c, t, g, unknown or other
  modified_base (3268463)..(3268573): a, c, t, g, unknown or other
  modified_base (3436585)..(3436594): a, c, t, g, unknown or other
  modified_base (3463834)..(3467017): a, c, t, g, unknown or other
  modified_base (3467080)..(3467332): a, c, t, g, unknown or other
  modified_base (3495566)..(3495627): a, c, t, g, unknown or other
  modified_base (3499134)..(3499270): a, c, t, g, unknown or other
  modified_base (3542644)..(3545582): a, c, t, g, unknown or other
  modified_base (3581055)..(3581114): a, c, t, g, unknown or other
  modified_base (3581304)..(3581583): a, c, t, g, unknown or other
  modified_base (3581800)..(3581976): a, c, t, g, unknown or other
  modified_base (3582058)..(3582160): a, c, t, g, unknown or other
  modified_base (3609430)..(3609606): a, c, t, g, unknown or other
  modified_base (3632919)..(3632928): a, c, t, g, unknown or other
  modified_base (3635019)..(3635322): a, c, t, g, unknown or other
  modified_base (3647026)..(3648382): a, c, t, g, unknown or other
  modified_base (3651182)..(3651249): a, c, t, g, unknown or other
  modified_base (3651334)..(3651415): a, c, t, g, unknown or other
  modified_base (3651578)..(3652378): a, c, t, g, unknown or other
  modified_base (3652455)..(3653060): a, c, t, g, unknown or other
  modified_base (3653241)..(3654516): a, c, t, g, unknown or other
  modified_base (3654674)..(3654866): a, c, t, g, unknown or other
  modified_base (3655025)..(3655491): a, c, t, g, unknown or other
  modified_base (3655635)..(3656855): a, c, t, g, unknown or other
  modified_base (3656990)..(3657107): a, c, t, g, unknown or other
  modified_base (3657371)..(3659282): a, c, t, g, unknown or other
  modified_base (3659306)..(3660452): a, c, t, g, unknown or other
  modified_base (3660514)..(3663199): a, c, t, g, unknown or other
  modified_base (3663802)..(3664035): a, c, t, g, unknown or other
  modified_base (3664206)..(3664362): a, c, t, g, unknown or other
  modified_base (3664599)..(3664625): a, c, t, g, unknown or other
  modified_base (3664677)..(3664707): a, c, t, g, unknown or other
  modified_base (3664855)..(3665509): a, c, t, g, unknown or other
  modified_base (3665851)..(3666049): a, c, t, g, unknown or other
  modified_base (3666178)..(3666562): a, c, t, g, unknown or other
  modified_base (3666784)..(3674156): a, c, t, g, unknown or other
  modified_base (3675047)..(3675199): a, c, t, g, unknown or other
  modified_base (3675479)..(3676043): a, c, t, g, unknown or other
  modified_base (3676267)..(3680330): a, c, t, g, unknown or other
  modified_base (3680699)..(3684565): a, c, t, g, unknown or other
  modified_base (3693839)..(3693928): a, c, t, g, unknown or other
  modified_base (3694034)..(3694150): a, c, t, g, unknown or other
  modified_base (3694298)..(3694429): a, c, t, g, unknown or other
  modified_base (3694681)..(3694684): a, c, t, g, unknown or other
  modified_base (3694831)..(3694987): a, c, t, g, unknown or other
  modified_base (3714855)..(3714883): a, c, t, g, unknown or other
  modified_base (3724797)..(3725979): a, c, t, g, unknown or other
  modified_base (3727526)..(3727584): a, c, t, g, unknown or other
  modified_base (3761606)..(3761692): a, c, t, g, unknown or other
  modified_base (3851715)..(3851772): a, c, t, g, unknown or other
  modified_base (3898999)..(3900622): a, c, t, g, unknown or other
  modified_base (3913437)..(3913565): a, c, t, g, unknown or other
  modified_base (3988742)..(3989593): a, c, t, g, unknown or other
  modified_base (3990797)..(3992279): a, c, t, g, unknown or other
  modified_base (4018482)..(4018498): a, c, t, g, unknown or other
  modified_base (4019655)..(4019667): a, c, t, g, unknown or other
  modified_base (4021052)..(4021150): a, c, t, g, unknown or other
  modified_base (4022630)..(4022779): a, c, t, g, unknown or other
  modified_base (4023213)..(4023588): a, c, t, g, unknown or other
  modified_base (4035587)..(4035669): a, c, t, g, unknown or other
  modified_base (4035704)..(4037455): a, c, t, g, unknown or other
  modified_base (4039030)..(4039121): a, c, t, g, unknown or other
  modified_base (4040876)..(4041066): a, c, t, g, unknown or other
  modified_base (4062012)..(4062203): a, c, t, g, unknown or other
  modified_base (4095038)..(4103413): a, c, t, g, unknown or other
  modified_base (4123601)..(4123883): a, c, t, g, unknown or other
  modified_base (4125321)..(4125365): a, c, t, g, unknown or other
  modified_base (4125476)..(4127668): a, c, t, g, unknown or other
  modified_base (4129766)..(4134136): a, c, t, g, unknown or other
  modified_base (4146966)..(4147099): a, c, t, g, unknown or other
  modified_base (4171054)..(4176434): a, c, t, g, unknown or other
  modified_base (4176590)..(4176615): a, c, t, g, unknown or other
  modified_base (4177944)..(4180911): a, c, t, g, unknown or other
  modified_base (4181015)..(4182198): a, c, t, g, unknown or other
  modified_base (4184818)..(4184847): a, c, t, g, unknown or other
  modified_base (4187258)..(4190945): a, c, t, g, unknown or other
atctttttcggctttttttagtatccacagaggttatcgacaacattttcacattaccaacccctgtggacaaggttttttcaacaggttgtccgctttgtggataagattgtgacaaccattgcaagctctcgtttattttggtattatatttgtgttttaactcttgattactaatcctacctttcctctttatccacaaagtgtggataagttgtggattgatttcacacagcttgtgtagaaggttgtccacaagttgtgaaatttgtcgaaaagctatttatctactatattatatgttttcaacatttaatgtgtacgaatggtaagcgccatttgctctttttttgtgttctataacagagaaagacgccattttctaagaaaaggagggacgtgccggaagatggaaaatatattagacctgtggaaccaagcccttgctcaaatcgaaaaaaagttgagcaaaccgagttttgagacttggatgaagtcaaccaaagcccactcactgcaaggcgatacattaacaatcacggctcccaatgaatttgccagagactggctggagtccagatacttgcatctgattgcagatactatatatgaattaaccggggaagaattgagcattaagtttgtcattcctcaaaatcaagatgttgaggactttatgccgaaaccgcaagtcaaaaaagcggtcaaagaagatacatctgattttcctcaaaatatgctcaatccaaaatatacttttgatacttttgtcatcggatctggaaaccgatttgcacacgctgcttccctcgcagtagcggaagcacccgcgaaagcttacaaccctttatttatctatgggggcgtcggcttagggaaaacgcacttaatgcatgcgatcggccattatgtaatagatcataatccttctgccaaagtggtttatctgtcttctgagaaatttacaaacgaattcatcaactctatccgagataataaagccgtcgacttccgcaatcgctatcgaaatgttgatgtgcttttgatagatgatattcaatttttagcggggaaagaacaaacccaggaagaatttttccatacatttaacacattgcacgaagaaagcaaacaaatcgtcatttcaagtgaccgaccgccaaaggaaattccgacacttgaggacagattgcgctcacgttttgaatggggacttattacagatatcacaccgcctgatctagaaacgagaattgcaattttaagaaaaaaagccaaagcagaaggcctcgatattccgaacgaggttatgctttacatcgcgaatcaaatcgacagcaatattcgggaactcgaaggcgcattaatcagagttgtcgcttattcatctttaattaataaagatattaatgctgatctggccgctgaggcgttgaaagatattattccttcctcaaaaccgaaagtcattacgataaaggaaattcagagggtagtaggccagcaatttaatattaaactcgaggatttcaaagcaaaaaaacggacaaagtcagtagcttttccgcgtcaaatcgccatgtacttatcaagggaaatgactgattcctctcttcctaaaatcggtgaagagtttggaggacgtgatcatacgaccgttattcatgcgcatgaaaaaatttcgaaactgctggcagatgatgaacagcttcagcagcatgtaaaagaaattaaagaacagcttaaatagcaggaccagggatcaatcggggaaagtgtgaataacttttcggaagtcatacacagtctgtccacatgtggataggctgtgtttcctgtctttttcacaacttatccacaaatccacaggccctactattacttctactattttttataaatatatatattaatacattatccgttaggaggataaaaatgaaattcacgattcaaaaagatcgtcttgttgaaagtgtccaagatgtattaaaagcagtttcatccagaaccacgattcccattctgactggtattaaaattgttgcatcagatgatggagtatcctttacagggagtgactcagatatttctattgaatccttcattccaaaagaagaaggagataaagaaatcgtcactattgaacagcccggaagcatcgttttacaggctcgcttttttagtgaaattgtaaaaaaattgccgatggcaactgtagaaattgaagtccaaaatcagtatttgacgattatccgttctggtaaagctgaatttaatctaaacggactggatgctgatgaatatccgcacttgccgcagattgaagagcatcatgcgattcagatcccaactgatttgttaaaaaatctaatcagacaaacagtatttgcggtgtccacctcagaaacacgccctatcttgacaggtgtaaactggaaagtggagcaaagtgaattattatgcactgcaacggatagccaccgtcttgcattaagaaaggcgaaacttgatattccagaagacagatcttataacgtcgtaattccgggaaaaagtttaactgaactcagcaagattttagatgacaaccaggaacttgtagatatcgtcatcacagaaacccaagttctgtttaaagcgaaaaacgtcttattcttctcacggcttctggacgggaattatccagacacaaccagcctgattccgcaagacagcaaaacagaaatcattgtgaacacaaaagaattccttcaggccattgatcgtgcatctcttttagctagagagggacgcaacaacgttgtaaaactgtccgcaaaaccggctgaatccattgaaatttcttccaattcgccagaaatcggtaaagttgtggaagcaattgttgcggatcaaattgaaggtgaggaattaaatatctcttttagtccaaaatatatgctggatgcactaaaggtgcttgaaggagcagaaatacgcgtaagctttacaggcgcaatgagacctttcttaattcgcacgccgaatgatgaaacgattgtacagcttatccttcctgtcagaacctattaatccgatacactgctgccgacccgtcggcagcttttctattcggtatctgctccgacaagttttccctttccctaattcgtttttttttagtacaattagatattagtgatatttgaaagaggtcgatataatggcaaatccgatttcaattgatacagagatgattacactcggacaattcttaaaattagccgatgtgattcagtctggcggtatggcgaagtggtttttaagcgagcatgaagtgcttgtgaacgatgagccggacaaccgccggggcagaaagctgtatgttggagatgtggtagagattgaaggatttggttcatttcaagtcgtcaattaaagcgggtgacactgattgtatatccagaacttagaactgacatcttaccgcaactacgaccatgctgaacttcaatttgaaaataaagtaaatgtgatcatcggagaaaacgcccaggggaagacaaacctcatggaggcgatctatgtcttgtccatggcgaaatcgcaccggacatcaaatgacaaagaacttatacggtgggacaaagactatgctaaaatagagggaagagtgatgaagcaaaacggggcgatcccgatgcagctcgtcatctccaaaaagggtaaaaagggcaaggtcaatcatattgaacagcaaaagctcagccagtatgtcggggccctcaacaccattatgttcgcgccggaagatttaaatcttgtaaagggaagccctcaagtgagaaggcggtttcttgacatggaaatcggacaggtttctcccgtctaccttcatgatctttctctttaccagaaaatcctttcccagcggaatcattttttgaaacagctgcaaacaagaaaacaaactgaccggacgatgctcgatgttctgaccgatcagcttgtagaagttgcagcaaaagtcgtcgtaaaacgcctgcagtttacagcacagctcgagaaatgggcgcagcccatccatgcaggcatctcaagagggcttgaagaactgaccctgaaataccatacagctcttgatgtatcagatcccctagatttgtcgaaaataggagatagctatcaagaagcgttttctaaattaagagaaaaagaaattgagcgtggtgtgacgctgtcagggcctcatcgcgatgatgttcttttctatgtgaacggacgcgatgtgcagacgtatggttctcaaggacagcagcgaacgacggcgttgtcccttaagctggcggagattgacctgatccatgaagaaatcggagaatatcccattttactattggatgatgtactgagtgaactggatgattatcgccagtcacacttgcttcatacgatccaaggccgtgtgcaaacgtttgtcacaacgacaagcgttgatggcattgatcacgaaaccttacgtcaagcaggaatgttccgtgtgcaaaatggtgcgttagtgaagtgaagaaatgaggtgagcaattgtatattcatttaggtgatgactttgtggtttcaacacgagatattgtcggcatttttgactttaaagccaacatgtcgcctattgttgaagaatttctgaaaaaacagaaacacaaggtggtgccttccgtaaacggcacgcccaaatctatcgtagtcacggttcagaatatatattactctcccttatcttccagcacattaaaaaaacgtgcgcaatttatgtttgaaatagattcttagaaattttttatcacgaatatatcgtttagaaaagtgtaggtgaatgacgtggctatggaacagcagcaaaacagttatgatgaaaatcagatacaggtactagaaggattggaagctgttcgtaaaagaccggggatgtatatcggttcgacaaacagcaaaggccttcaccacctggtatgggaaattgtcgacaatagtattgacgaagccctcgccggttattgtacggatatcaatatccaaatcgaaaaagacaacagtatcacggttgtagataatggccgcggtattccagtcggtattcatgaaaaaatgggccgtcctgcggtagaagtcattatgacggtgcttcatgccggaggaaaatttgacggaagcggctataaagtatccggaggattacacggtgtaggtgcgtcggtcgtaaacgcactatcaacagagcttgatgtgacggttcaccgtgacggtaaaattcaccgccaaacctataaacgcggagttccggttacagaccttgaaatcattggcgaaacggatcatacaggaacgacgacacattttgtcccggaccctgaaattttctcagaaacaaccgagtatgattatgatctgcttgccaaccgcgtacgtgaattagcctttttaacaaagggcgtaaacatcacgattgaggataaacgtgaaggacaagagcgcaaaaatgaataccattacgaaggcggaattaaaagttatgtagagtatttaaaccgctctaaagaggttgtccatgaagagccgatttacattgaaggcgaaaaggacggcattacggttgaagtggctttgcaatacaatgacagctacacaagcaacatttactcgtttacaaacaacattaacacgtacgaaggcggtacccatgaagctggcttcaaaacgggcctgactcgtgttatcaacgattacgccagaaaaaaagggcttattaaagaaaatgatccaaacctaagcggagatgacgtaagggaagggctgacagcgattatttcaatcaaacaccctgatccgcagtttgagggccaaacgaaaacaaagctgggcaactcagaagcacggacgatcaccgatacgttattttctacggcgatggaaacatttatgctggaaaatccagatgcggccaaaaaaattgtcgataaaggcttaatggcggcaagagcaagaatggctgcgaaaaaagcccgtgaactaacacgtcgtaagagtgctttggaaatttcaaacctgcccggtaagttagcggactgctcttcaaaagatccgagcatctccgagttatatatcgtagagggtgactctgccggaggatctgctaaacaaggacgcgacagacatttccaagccattttgccgcttagaggtaaaatcctaaacgttgaaaaggccagactggataaaatcctttctaacaacgaagttcgctctatgatcacagcgctcggcacaggtattggggaagacttcaaccttgagaaagcccgttaccacaaagttgtcattatgacagatgccgatgttgacggcgcgcacatcagaacacttctgttaacgttcttttacagatatatgcgccaaattatcgaaaatggctacgtgtacattgcgcagccgccgctctacaaggttcaacaggggaaacgcgttgaatatgcgtacaatgacaaggagcttgaagagctgttaaaaactcttcctcaaacgcctaagcctggactgcagcgttacaaaggtcttggtgaaatgaatgccacccagctatgggagacaaccatggatcctagctccagaacacttcttcaggtaactcttgaagatgcaatggatgcggacgagacttttgaaatgcttatgggcgacaaggtagaaccgcgccgaaacttcatagaagcgaatgcgagatacgttaaaaatcttgacatctaatcataaaaagccttatttccaataagaaataaggcttttttctgaacaagatcagatgcagcaatgcttgcaatacctatatattctagcaatttaatgtgtataatcataagtttattgatataatggagaatagtgaaatcgtattgaaggtcataatggacaatctactcccacatatttcatgtgatacttcagggaggttttttaatgagtgaacaaaacacaccacaagttcgtgaaataaatatcagtcaggaaatgcgtacgtccttcttggattatgcaatgagcgttatcgtgtcccgtgctcttccggatgttcgagacggtttaaaaccggttcatagacggattttgtatgcaatgaatgatttaggcatgacaagtgacaagccttataaaaaatccgcgcgtatcgttggagaagttatcgggaaataccacccgcacggtgattcagcggtatatgaatccatggttagaatggctcaggatttcaactaccgttatatgctcgttgacggtcatggaaacttcggttctgttgacggagactcagcggcggccatgcgttatacagaagcaagaatgtctaaaatctcaatggagattcttcgcgacatcacaaaagacacaatcgattaccaggataactatgacgggtcagaaagagaacctgtcgttatgccttcaaggttcccgaatctgctcgtgaacggtgctgccggcattgcggtaggtatggcaacaaacattcctcctcaccagctgggagaaatcattgacggtgtacttgctgtcagtgagaatccggacattaccattccagagcttatggaagtcattccagggcctgatttcccgaccgcgggtcaaatcttgggacgcagcggtatccggaaagcatacgaatcaggccgaggctctatcacgatccgggcaaaagctgagatcgaacaaacatcttcgggtaaagaaagaattatcgttacagagttaccttaccaagtaaataaggcgaaattaattgagaaaattgctgatctcgtaagggacaaaaagatagagggtatcacagatctgcgtgatgagtcagatcgtacaggtatgagaattgtcattgaaataagacgcgatgccaatgcaaatgtcatcttaaacaatctgtacaaacaaactgctctacaaacatcttttggcatcaacctgcttgcacttgttgatggccagccgaaagttttaactcttaagcaatgcctggagcattaccttgaccaccaaaaagttgtcattagacgccgtactgcttatgaattgcgtaaagcagaagcgagagctcatatcttggaaggattgagagttgcactggatcatctcgatgcagttatctcccttatccgtaattctcaaacggctgaaattgcgagaacaggtttaattgaacaattctcactgacagagaagcaagcacaagcgatccttgacatgaggctccagcgtttaacgggactggaacgtgaaaagatcgaagaagaataccaatctcttgttaaattaattgcagagctaaaagacatcttggcaaatgaatataaagtgcttgagatcattcgtgaagaactcacggaaatcaaagagcgttttaacgatgaaagacgtactgagatcgtcacttctggactggagacaattgaagatgaagatctcatcgagagagaaaatatcgtagttactctgacgcacaacggatacgtcaaacgtcttcctgcatcaacttaccgcagtcaaaaacggggcggaaaaggtgtacaaggtatgggaacaaacgaagatgatttcgttgaacatttgatatctacgtcaactcatgacacgattctcttcttctcgaacaaggggaaagtgtatcgtgcaaaagggtatgaaatccctgaatacggcagaacggcaaaaggaatcccgattattaacctgctggaggtagaaaagggtgagtggatcaacgcgattattccagtcacggaattcaatgcggagctttaccttttcttcactacaaagcatggggtttcaaaacgaacatcactatctcaattcgctaatatccgcaacaatggtctaatcgctctgagtcttcgtgaagacgatgaactgatgggtgtacgtctgactgatggcacaaaacaaatcatcattggaacgaaaaacggtttactgatccgtttccctgaaacagatgttcgggagatgggaagaactgcggcgggcgtaaaaggcatcaccctgacggatgacgacgttgttgtcggcatggagatattagaggaagaatcacacgtccttatcgttactgaaaaagggtacggaaaacgaactccggctgaagagtacagaacccaaagccggggcggaaaaggactcaaaacagcgaaaatcaccgagaacaacggccaactagtagcagtgaaagctactaaaggtgaagaggatctaatgattattacagctagcggcgtactcatcagaatggacatcaatgatatctccatcaccggacgtgtcactcaaggtgtgcgtctcatcagaatggcagaagaagagcatgttgctacagtagctttagtagagaaaaacgaagaagatgagaatgaagaagaacaagaagaagtgtgaaaaaaagcgcagctgaaatagctgtgctttttttgtcataaccctttacagccataaaaattatggtataatcatttctgttgtctttttaaagacacaagcatgaccattatgactagtaaaaacttttttaaaaaagtattgacctagttaactaaaaatgttactattaagtagtcgcttcgagagaagcacacaaagttctttgaaaactaaacaagacaaaacgtacctgttaattcagtttttaaaaatcgcacagtgatgtgcgtagtcagtcaaactagggcctgcacgacgcaggtcacacaggtgtcgccgcaggatgtggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccgctcgtaatggagtggtatccatatctgaattcataggatatgagaaggcagacccggggaactgaaacatctaagtacccggaggaagagaaagcaaatgcgattccctgagtagcggcgagcgaaacgggatgagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatctcgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagtttaaacccagctcattgagctgggttttttgtttgttaaaaatgaagaagaaactgtgaagcgtatttagggaatttcttttctgatactaataaaaactgctgaattaacacgtagtcatcacttatatgctgtgttaataactcataccaccattctgtttcataccttgcaatcattccaacgttgtacaaaatcaaataatgaattgtcatttcgggaagcctcagaaattgctccctttgagaagggatataatattggttctttttcatgtcaaacaataagctggtcgatgtccatggctccttgtcttgtggtgaaatttcgaacagcagcccgtgttcatttttttttgtaaaagaccattgataatgatgggacatgtattcagcaaaccttgaatcagacattttgtaattgattactacttcctccggtacaaaaatttcgttcttatccttctcaacttttgttataaatcgttctttctgctgaaagtagaaaatatcgctaagttctggaatggccattaataattttttcatggtataccgttcatctactatatccgattgtccgaataaatgtttcataaaatgtacgcataggccattccgttgtattttcacttcatcatcgctaaaacaataattttgtttctttcgttttcttgttgttacgccatgtgccagtaccgatgtatggcttggataatgaggatcacgtgtaattaagcatgctttgataagctgtgccattccataaaataaaagaatcggtttgatttctaagggagaatatgcggcttgtttataaaacgattcggcatgctttaagaaataaataaaccgttcactgtttttaaaagagttttttttcgcatcgtcaataccgtttaagatataaaccttttctagaaatttctgggttgattcaacggagtaaaatagcgctaagtctttccactcatgatatgtcatgtatatttcttaatcctttccgttatctaaatatttcaactctttcccgcttccttgacatgctcttggctagttgataatctacatataatattttgccgaaaagagggggatttactaatgtgggaaagtaaattttcaaaagaaggcttaacgttcgacgatgtgctgcttgtgccagcaaagtctgaggtacttccgcgtgatgtggatttatctgtagaacttacaaaaacgttaaagctaaatattcctgtcatcagcgcaggtatggacactgtaacagaatcagcaatggcaattgcaatggcaagacagggcggcttgggcatcattcacaaaaatatgtccattgaacagcaggctgaacaagttgataaagtaaagcgttctgagcgcggcgttatcacaaatcccttctttttaactcctgatcaccaagtatttgatgcggagcatttgatggggaaatacagaatttccggtgttccgattgtaaataacgaagaagaccagaagcttgttggaattattacaaaccgtgaccttcgttttatttctgactactcaatgaaaatcagcgacgtcatgacgaaagaagagctagttactgcatctgtaggaactactctggatgaagctgaaaagattttgcaaaaacataaaattgaaaagcttcctctcgtagatgaccagaataaattaaaaggtcttatcacaattaaagacattgaaaaagtcattgagttcccgaactcatctaaagacattcacggccgcctgatcgttggcgcggcagttggtgtaactggcgatacaatgactcgcgtcaaaaagcttgttgaagccaatgttgatgtgattgttatcgatacagctcacggacactctcaaggcgttttaaacacagttacaaaaatccgtgaaacgtatcccgaattaaacattattgctggaaacgtggcaacagctgaagcgacaagagcgcttatcgaagctggagcagacgttgtcaaagttggaatagggcctggttcaatttgtactacacgtgttgtagccggggtgggtgttccgcaaattacagcaatttatgattgtgcgactgaagcaagaaaacacggcaaaacaatcatcgccgacggtgggattaaattctctggcgatatcactaaagcattggcagccggcggacatgctgttatgctcggaagcttgcttgcaggcacatcagaaagccctggtgaaactgaaatctaccaaggcagaagatttaaggtataccgcggcatgggatcagttgctgcaatggaaaaaggaagtaaagaccgttacttccaagaagaaaacaaaaaatttgttcctgaaggaattgaaggacgcacaccttacaaagggccagttgaagaaaccgtttatcagctagtcggaggccttcgttctggtatggggtattgcgggtccaaagatctgcgtgcgctaagagaagaagctcagttcattcgcatgactggcgcaggacttcgcgaaagccatccgcatgacgtacagattacaaaagaatcacctaactatacaatttcataataaattgttacaaattaaaaacatttgacagggtctctgactctgtctattttttttatactgattatgataaaatttatactgttgtgcattgaaaatgtccttaacggcttaattatagatgaagaaaatgaaatacggaggtcgtacgattgaacatcaagaaatgtaaacagctactgatgtcattggttgtgttaactctagctgtcacgtgtctggctccaatgtcaaaagcaaaagcagccagcgatccaattgatatcaatgcatctgctgctattatgatcgaagcttcttcaggtaaaattctttacagtaaaaatgcagataagagactgccaattgcgagtatgacaaaaatgatgacagagtatctgttattggaagcaattgatcaaggtaaagtgaaatgggaccaaacctatacgcctgatgactatgtgtatgaaatttcccaagataacagcttatcaaacgttcctcttcggaaagacgggaaatacacagtaaaagaattatatcaagctacagcaatttattctgcaaatgctgctgctattgcgattgcagaaatcgttgcaggttctgaaactaagtttgttgaaaaaatgaatgcaaaagcaaaagaactagggttaacagattacaaatttgttaacgcaacaggtcttgaaaacaaagatcttcacgggcatcagcctgaggggacaagcgtaaatgaagaaagtgaagtttctgcaaaggatatggcgattcttgcggatcacttgattactgactaccctgagatactggagacttccagtatcgccaaaacgaaattccgagaaggcaccgatgatgaaatggacatgccgaactggaattttatgctgaaggggcttgtcagcgagtataaaaaagcgactgtagacggactgaaaacaggttctactgactctgcgggttcatgctttacaggaacagctgaacgcaacggtatgcgtgtcatcactgttgttttaaacgcaaagggcaaccttcatacaggccgtttcgatgaaacgaagaaaatgtttgattatgctttcgacaatttctccatgaaagaaatttatgctgaaggcgatcaagtaaaaggccataaaacaatttcagttgataagggtaaagagaaagaagtaggcattgtgacaaacaaggcgttctctcttcctgtcaaaaatggtgaagaaaagaattacaaagcgaaggtcacactgaataaagacaacttaactgctcctgtgaaaaaaggaaccaaggttgggaagctgactgcggaatacacaggtgatgaaaaggattacggattccttaacagcgatctggctggcgtagaccttgttacaaaagaaaatgtagaaaaagcaaactggtttgttttgacaatgcgcagtatcggcggattttttgccggaatttggggaagcattgttgatacggtaaccggctggttttaatcaattgaaagagctctgatggatgttagggctctttcgcgtaatatactgaaaaaacccaatttttaataaaaaatgattttcaaagcgctaaaaaccgaataaaatagtatatatccatatgaattattggatttctaggatacaataaggattagaaatcatataactataccttgattagggggaccaagaaatggctcaaacaggtactgaacgtgtaaaacgcggaatggcagaaatgcaaaaaggcggcgtcatcatggacgtcatcaatgcggaacaagcgaaaatcgctgaagaagctggagctgtcgctgtaatggcgctagaacgtgtgccagcagatattcgcgcggctggaggagttgcccgtatggctgaccctacaatcgtggaagaagtaatgaatgcagtatctatcccggtaatggcaaaagcgcgtatcggacatattgttgaagcgcgtgtgcttgaagctatgggtgttgactatattgatgaaagtgaagttctgacgccggctgacgaagaatttcatttaaataaaaatgaatacacagttccttttgtatgtggctgccgtgatcttggtgaagcaacacgccgtattgcggaaggtgcttctatgcttcgcacaaaaggtgagcctggaacaggtaatattgttgaggctgttcgccatatgcgtaaagttaacgctcaagtgcgcaaagtagttgcgatgagtgaggatgaactaatgacagaagcgaaaaacctaggtgctccttacgagcttcttcttcaaattaaaaaagacggcaagcttcctgtcgttaactttgccgctggcggcgtagcaactccagctgatgctgctctcatgatgcagcttggtgctgacggagtatttgttggttctggtattttcaaatcagacaaccctgctaaatttgcgaaagcaattgtggaagcaacaactcactttactgattacaaattgatcgctgagttgtcaaaagagcttggtactgcaatgaaagggattgaaatctcaaacttacttccggaacagcgtatgcaagaacgcggctggtaagaacatgggagcgctgctgacatgttaacaataggtgtactaggacttcaaggagcagttagagagcacatccatgcgattgaagcatgcggcgtggctggtcttgtcgtaaaacgtccggagcagctgaacgaagttgacgggttgattttgccgggcggtgagagcacgacgatgcgccgtttgatcgatacgtatcaattcatggagccgcttcgtgaattcgctgctcagggcaaaccgatgtttggaacatgtgccggattaattatattagcaaaagaaattgccggttcagataatcctcatttaggtcttctgaatgtggttgtagaacgtaattcatttggccggcaggttgacagctttgaagctgatttaacaattaaaggcttggacgagccttttacaggggtattcatccgtgctccgcatattttagaagctggtgaaaatgttgaagttctatcggagcataatggtcgtattgtagccgcgaaacaggggcaattccttggctgctcattccatccggagctgacagaagatcaccgagtaacacagctgtttgttgaaatggttaaggaatacaagcaaaaggcacttgtataaaacagttgaaagctgtggaaacttatagtacattataagcacaaataaagatcgaaaagcgttgataggaactagtagggagcctctctttctaagagagccgatggttggtgcgaatcggtgaaagatgctgtctgaatccatccttgagcgaaatgctgaaacaagtaggcatttacgggataaccgttatgtttgaaagtggaaaacgagtctttgatttgttttcaatcagggtggcaacgcgagagctctcgtccctttatggggatgagggctctttttattttcgacaaatcaataaaaaaaggagtgtttcgcatgcttgatacgaaaatgctgagagcaaattttcaagaaattaaagcaaagcttgtacacaaaggcgaagacttaactgattttgataagtttgaggcgctggatgatagacgaagagagcttatcggcaaggttgaagagttaaaaggaaaacgaaatgaagtttctcagcaggttgctgtgctgaagcgtgagaaaaaagaagcggatcacattattaaagaaatgcgtgaagtcggcgaggaaattaaaaagcttgatgaagaattgcgaacagtggaagctgagcttgatacaatccttctctcaatcccgaatattccgcatgagtctgtacctgtcggtgaaacagaagacgacaacgtagaagtgcgtaaatggggtgaaaagccttcatttgcttatgagccgaagccgcactgggatattgcggatgagctgggtattctggattttgaacgtgctgccaaagtaacaggaagccgtttcgtgttctataaaggcttaggtgctcgtctggagcgtgcactttataactttatgcttgatctgcatgtggatgagtataactacactgaagtgatcccgccatatatggtaaaccgcgcaagcatgacgggaacaggacagcttcctaaatttgaagaggatgcatttaaaatcagagaagaagattatttcttaatttcaacggcggaagtgccgattacaaacatgcatcgcgatgaaatcctttcaggtgacagcctgccgatcaactatgcggcattcagtgcttgcttccgttctgaagctggttcagcaggacgtgacacacgcggattaattcgtcagcaccaatttaataaagttgagcttgtaaagtttgtgaagcctgaagattcttatgaagaattagagaagcttacaaaccaagcagaacgggttcttcagctgcttgagcttccataccgtgtcatgagcatgtgtacgggtgacttaggctttacggctgcgaaaaaatacgatatcgaagtttggattccgagccaagacacatatcgagaaatttcttcttgcagcaactttgaagcgttccaggcgagacgtgcgaatattcgtttcagacgtgaagcgaaaggcaagcctgagcatgtacacacactgaacggttcaggactggcggttggaagaacagttgccgctatcttagaaaattatcagcaggaagacggaagcgttgtgattccgaaagtgcttcgtccttatatggggaatagagaagtaatgaaaccgtaaattatggaaaggcgtgcctgacaaggtgcgcctttttgcttatgtaaacatggcattttcataaaaacaaaaaaagtttttaaaaatgcttgaccacacgagaacatacgtgatatagtaagtcttgtcgatacggaggaatacccaagtccggctgaagggatcggtcttgaaaaccgacaggggtgtcaaagcccgcgggggttcgaatccctcttcctccgccatattgattttaattctaatgaaacacaagcatatattggagattgttttgtccgttgcattcggtgcggcggattttttattttaaagaaaaagtgaatctcgactgagattcactttttttgattatcatgaataactgaagcaatttgatctacaatattttcaatcgagttttcgtcgttcagaagatcataatcttcaatgcgaagttttaaaacagggcaggcattaaaaccgcttatccagttctcgtagcgtgtatgcatttcttcccaataagacctgcttgtctgaagctccatctcacggccgcgttgttcaatccggtttaaaatgttctccagatctccttctaaatagatcaacacatctgggtgtgggaaatacggtgtcattaccattgcttcgaaaaggcttgtgtaagtcttataatcaacctttgacattgtccctttatcagcatgcatttttgcgaaaattcctgtatcttcataaatcgaacgatcctgtacaaaacctccgccggcttcaaaaattgttttctgttctttgaagcgttcagctaagaagtaaatttgaaggtgaaagctccaacgttcaaaatcatgatagaacttttccaaatatggattatgatcgacttcctccaaagatgttttaaatccaagccgtttagctaaagtttttgttaaagtcgattttccgacacctactgttcctgctactgtaataattgaattcttagggatatgatgttccttcatacgataagctcctttacatgggcggcaatgcgttcaaagtcgctcttattcaaaacgaaatcctttgaatcaccatctacggttaacactgtaagtttagggtctgcttcctgcagctgcttgatggcgacttcataatctgaaatcagctgctccaaatagctagtttcaatttttttctcaaaggggcgcccgcgtttttcaatgcggtgtagcaatgtaggcagactggcctttatgtaaatgatgaaattcggctttggcagatcatccgttagcaggtgatatatctttttgtatttttccagctgatgtggagacaaggtgcgttccgcaaaaatcacatttttataaatatgataatcagctattacaggctgtcccttttttaaaaagtgatcactggtgtcttcaagctgtttgtatctgtgacaaagaaaaaacatctcgagctggaagctccattcctctatattgtcataaaacttatcaaggtacgggttatcctctacaatctcattgatcatagggaatccgaattcttgtgagagcatcgttgcgagagttgtttttcctgccccgataggaccttctattgcaataaaaggggctgtattcatcggaatcctccttatatctgaaaaacgtgcgtcagttaccgaccttcatattgtatcacaacccttgggtgcccccatgaaaaaaagacgtttccaaattatcgaaacgtctttttgacaacattaaattgatcagacagcagcagccagttttgtggaaaggaaagacccagcttccaatagctgatgcctcttaaattcagctctttaatcagattgaattttgcttgaatcgagcgggcatcctcgaaccatacctcgtgccttctgttttctgcatcagtatagcggaagaaaggagcttgagcggtttgatcatactgaatggaagcattgttctgatcagctatgacaatggcttgctgagggcttactgctcttgccggagttccccctgctgtatatggcagcgtccagtcatatccatataaattctggcccatgacaattttgttcgcaggcatttcagtcaaagcatattctatgacatcacggacaggtccaattggagaaaccgcttgaggcggcccgccgctatagccccattcatatgtcatgagaacaacaaagtcgacaatttggccatgtgccctgtaatcatgagcttcataccatctgccctgctgtgttgcacttgttttaggagcaagagccgtagaaatttctaagccctctcgatgaaaaagatcccttgcttcgcggaggaattgattataagcctctctatcctggggccgcaaatattcaaagtcgaaatgaatgtcacggaagccatatcttctggcattctcgactatttcatttagaagccgtctttttacagtttcgtcgttcaaaaggatccggccaagttcatcgctgaatgcttggttttctaggttcgttataatcatcatcaatgttgtattttgactttctgtaatgctccttaaattcgttaaaggcggtgcgactaaggttccgttacgctgtgcctggaagttgaatgcgccaaggtacgttaagtagggcgacgattctctggccgcctgctggagattttcgctgacttgatttcctcggggctccaaataagcatttgattcgatgtctcgtttaggagatggtgggatgtataaacggaaaccaatctgaagcacggtatttaactggatgcggttaacccttgcgagctcggctgccgttgtattgaactgccgggcgatagatgtcagggtatcacctcgcttcacatcatagaactggccagctattggaatgacaatggtttgtccgacaacaaggctgtcgggattcggtatttcattcgtttcagcgatctcatttgcggttgttctgtattgtgaagcgatagcagaaagagtgtcgccttgttttaccacataaatttgaatgaaaaacgcctcctttcatatcgctatcaatgtatgaaagaaaagcgctgatcatgtttatttttctgtaatttgttcttccgtcgtaatttctgcgaaaagaacattctccatcatagttaaggcgaattcgttatcttcgtcactgtttgacgcgatacagtccttaggaatcgtgatgctgtattccctcatataagcgtcattagcagtaaacagcacacatatattgccggctatacctgttaagataatatgtctcacctgcaactcagtaagaagggtgtgaagtgcagtttcgtagaaagcggaatgtttcggtttgattaaaaaataatcagcatctttcggagctatctttgtgatgatatccttgcttctttcatttgtgcattcttgctgaatgtttttaatgtcagcttgccaaagtccataatgatcattgatgtaaataatcggccattcattttgtctcgcgtgctcctttaatgataaaatatgaggaacgattttttctgtttttttagcgagggtttctcccatatcgaattcaaaattattgatcatgtctacaatgagaagggctgtatctgctttggacaatcgacagtctcctttccgtttcagttatagttaatatgtagcctttttaggcgatgaaaaaactttgaaaagagagcttatccttatgacacaagatgaactttatatgaaagaagcaattaaagaagcgaaaaaggctgaagagaaaggtgaagtgccaataggtgcggtgcttgtcgttaatgatgaaattatagcgcgtgcacataatttaagagagactgagcaacgatctattgcccatgcagaaatgcttgtaattgatgaagcatgtaaggcactcggaacatggcggctggaaggtgcgactctttatgtgacgcttgagccatgtccaatgtgtgctggtgccgtcgtactttctcgagtggaaaaagtggtttttggcgcatttgatccgaaaggcggctgttcaggcacactaatgaaccttcttcaggaggaacgctttaatcatcaggctgaagtggtgagcggtgtacttgaggaagaatgcggcggaatgctcagtgcgtttttcagagaactaagaaaaaagaagaaagccgccaggaaaaacttgtctgaatagtacggttgcaatttttaggggaaacagatatacttaagtgtgcatcgtaatagatgcaacataaaatttgatatttattttgccgtgctaagcggggaggtagcggtgccctgtacctgcaatccgctctagcagggccgaatcccttctcgaggttcgtttactttaaggcctgccttaagtaagtggtgttgacgtttgggtcctgcgcaatgggaattcatgaaccatgtcaggtccggaaggaagcagcattaagtgaaacctctcatgtgccgcagggttgcctgggccgagctaactgcttaagtaacgcttagggtagcgaatcgacagaaggtgcacggtaaatcaatcatcaaattttcagactcacctaacattaggtgagttttttgttatgtaaaaagagcttttggaatcgaaacaaggttcatgtataatgggaatgatgaataacggaggagggcaaacccgtgagttaccaagctttatatcgagtattcaggcctcagcgctttgaagatgtggtcggacaagaacacattacaaaaacgctgcaaaatgcccttttgcaaaaaaagttttctcacgcctatctgttttccgggccaagaggaaccggaaaaaccagtgcagccaaaatatttgctaaggctgtcaactgtgaacatgctcctgttgatgagccatgcaacgaatgtgcggcctgtaaagggataacaaacgggtcaatatccgatgtcatagaaattgacgccgcttctaataacggtgttgatgagattcgtgacattcgcgataaagtgaagtttgccccatcggccgtcacatataaggtatatatcatagatgaggtgcatatgctttctatcggcgcttttaatgcattactaaaaacattagaagagccgcctgagcattgtatcttcatattagcaacaactgaaccgcacaaaattcctttaaccattatctctagatgtcagcgttttgactttaaacgaattacctcccaagcgattgtagggcgcatgaataaaattgttgatgctgaacagctgcaagtggaggaaggatcgctggatatcatcgcgagtgctgcagacggagggatgagggatgccctgagccttcttgatcaggccatatcattcagcggcgatatcctgaaagtcgaagatgcgcttttaattacgggtgctgtttctcaattatatatcgggaagcttgcacaatccctgcatgataaaaacgtttctgacgcactggaaacattaaatgaattgcttcagcaaggaaaagatccagctaagctgatagaagatatgattttctatttcagggacatgctgctgtacaaaacagcccctggcttagagggagtgcttgagaaagtaaaagtcgatgaaacgttccggaaactaagtgaacaaattccggctcaggccctatatgaaatgattgatattctgaacaagagccatcaggaaatgaaatggacaaatcatccgcgtatctttttcgaagtggccgttgtgaagatttgccaaacctcacatcaatctgctgctgatctcccggaagtggatatgctgatgaaaaaaatccagcagctcgaacaggaagtagagcggctcaaaacaacgggcataaaagcagctgcggaaagcccgaaaaaagaagcgccgcgtgtgccaaagggcgggaaatccaattacaaagcgccagtaggcagaattcatgagattttgaaggaagccacaagaccggatcttgatctgctcagaaacagttggggcaagcttcttgctcatctcaaacagcaaaacaaagtatcgcatgccgctttgctgaatgacagtgaacctgtggctgccggatcggcggcatttgttctgaaattcaaatatgaaattcattgtaaaatggttgctgaggataacaacggagtccggactaatcttgagcagattttagaatcgatgctcggaaaaagaatggatttgattggcgttccagaagcacaatggggtaaaataagagaagaatttttagaagatcatcagcaggaaaatgaaggatcaaatgaaccggctgaagaagacccgcttattgccgaagcgaaaaagcttgttggagcggatttaattgaaataaaagactaacaaaatgaaagagagtgaatgctatgcgtggcggaatgggtaatatgcaaaaaatgatgaaacaaatgcaaaaaatgcaaaaggacatggcgaaggctcaagaagagcttgcagaaaaggttgttgaaggaactgcaggcggcggtatggtaacagtaaaagcaaacggccaaaaagaaatcctggatgttatcatcaaagaagaagtcgttgatcctgaagatattgatatgcttcaagatttagtgcttgctgcaacgaatgaagctttgaaaaaagttgacgaaatcacaaacgaaacaatgggtcaatttacaaagggaatgaacatgccaggtttattctagggggataaaagaacatgcaatatcctgaaccaatatcaaagctgattgacagctttatgaaattgccagggatcggaccgaaaacagcggttcgtctggctttttttgttctaggtatgaaagaagatgtagtattagattttgcgaaagcattagtaaatgcgaaacgcaacctgacatattgttcagtttgcgggcatattacagatcaggacccttgctatatatgtgaagatacgcgcagggataagtctgttatctgtgttgtgcaagaccctaaggatgttatcgctatggagaaaatgaaggaatacaacggacagtatcacgttcttcacggcgctatttctccaatggacggcattggaccggaggatattaaaataccagaattgttaaaacgattacaggatgatcaagtgacagaagtgatcctcgcgacaaaccctaatatagaaggggaagcaacggcgatgtatatatcaaggctcctcaagccgtctggtattaagctctcccgtattgcccacggactgcccgtcggcggtgacttggaatatgctgacgaggtcactctttctaaagcacttgaaggaagacgcgaattgtaaggaggaaaaagcgatccatgggttttcttcgcaagaaaacattaagaagagagtttgatgaaaaactaaccgagcagctttttaagcaaaaggaagagtggaacaggcaaaaaaagctggtcgaaaaaagcttagaaccgtctgctgaagtgttatacgaactgaaagtagctgaagcgaagtattttttttacttaagggaagcgaagcagcgaaatttaaaaatcagccggtggaagtaagtggtctaaactcctggatcttctcataagcttgtactagaacaagcgaaggagatgagaagattcatggagcctatttttattattgggattattttaggattggttattcttctttttttatcaggttcagctgcgaagcctttaaagtggattggcatcacagctgttaaatttgtggcaggtgctttgctgctggtttgtgtaaatatgtttggcggcagtcttggcattcatgtgccgattaatctggttacaacagctatcagcggaattttagggatacccggaatagctgcgttagtcgttattaagcaatttatcatttaattgatattatgtattgacttagacaaccgaaggtgttattctagtatacgtcgctgatgacgaacagcttttttgaaaagaaaatgttaaaaaagttgttgacagtagcgacggtaaatgttatgataataaagtcgcttaaacgagcggtaaacaaagttctttgaaaactaaacaagacaaaacgtgcctgttaattcagtttttaaaaatcgcacagcaatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggaactttgttccttgaataagttaagatgggcctgtagctcagctggttagagcgcacgcctgataagcgtgaggtcggtggttcgagtccactcaggcccaccatcttatataacggggccttagctcagctgggagagcgcctgctttgcacgcaggaggtcagcggttcgatcccgctaggctccaccaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccgctcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcagtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacacctctctaaaggcggaaggtaaggaaactccgctaagggctctcacatcctgtgagaaacgcccagtaccttcatcctgaaggcatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgtttactcaagatcgagaaaatcaaacaaatacaaacaccgagggcttatacagcccatatactaatttcaagtttcgaaaagatctaaatagtgtatacaatatccgttttaaggggaggctaattgtacggaggtggagaagatggacgaaacagttaaacttaatcatacatgtgtgatttgtgatcaagagaagaatagaggcattcatctttatacgaaattcatatgcttagattgtgagagaaaagtaatttctacatcaacttctgatcctgactatgcgttttacgtaaaaaaactaaagagcattcatacaccgccattatattcatagacctgaaaaggtctttttttgtactcttaataataaaaagaagatgaaacttgtttaaggattgaacgtagtagataataatattaaaactgagtatagacacaggagtcgattatctcatgcagagattttttcactttttgatgtggagtttaactagcagtgcgacttttgttttcattggaatattgagcttttttggtttaaaccagtcgctttttttatctattgtttatgggcttgcttctggagcagccgtatatatagctggcatctggaatgcaagacggttatttcttaaaaagcatgaattgacaggaagagagtatgcttacattaagaaaaacttagaggaagcaaggcagaaaatgatccgtcttaggaaagccttgtttcaggctaaaagcattcaaatgtttaagcaaaatgcagaaatgctaaggattgtgagaaggatttatctcctcaccaaaaaagagccaaagcggttttatcaggcagaacgatttttttatcaaactctcgattcggttgttgaattgacagagaagtatgcttttctatcatctcacccaaaaaaaagcaaagaactgtcgatgtcgttaagtgagacacgcatcactcttactgaattgaccaagcgtttagaggaagatttaactcaagcaatgggtgatgaaattgacgagttgcagtttgaattagacgcagcaaaacattcattaaagaaataagggaagagggtaagagcgatgaaccgagaccaaagcgaccttcatatagatgaattattggcagatccttttggtggtaacatagagataccaggttcggaggctgtaaaagcagagaaagagcaagtacggcttgttgatgttcttcctgaggaaaacaaggaaaaagcaattcagcttgctggacagattgatcataaaaatatgcaaagcattgtcttatacggttcacaagctcaatctaaactgctgaacttttctcatgatatgattaatcatgttcaaaagaaggatgtcggggagattggcgaaatacttggagagctgatgaaaaagctggagcaagtaaatcctgatgatctccaatctaagaaaaagggtattttggcacgcatgtttggaagagtatcaagttctcttcaagaggtgctgtctaaataccaaaagaccagtgtgcagatagacagaatcagcttgaagctggagcactctaaaaatgctttaatcagtgacaacaagctgttagagcagttatatgaaaaaaataaagaatattttgccgcgctgaatgtttatattgctgcaggagaactgaagctggaggaattaaaaacaaaaacgattcctgaactgaagcaacaggctgaatcgagtgatcataaccaaatggccgttcaagaggtgaatgatttaattcaatttgctgaccggttagataaaagggtgcatgatttgctgctgagcaggcaaattacaattcaaagtgcaccgcaaatcaggctgattcaaaatacaaaccaagcgttagctgaaaagattcagtcatccattgtgacagcgattccgttatggaaaaatcaagttgccattgcgctgacgcttttaaggcagcgcaatgcagtggatgcacaacagaaagtatctgatacaaccaatgagcttttgctgaaaaatgcggagcttttaaaaaccaatacaattgaaactgcacgggcaaatgaaagaggccttgttgatatagataccttgaagaaggtgcaggaaagcttaataagcacgcttgaagaaacactgactatacaagaagaaggacgaatcaaacgccgtcaggcagaagaagagctcatgatgatggaaggcgacctgaagcaaaagctgcttacaataaaggaaagatagttaccagtaagtctggctttaagttctctcagaggcacgatataataaggtgtaagaagacacattcaaaggattgttttcatgaacacacctttatataaagcattaattcaacatgcgagaagaaattctcattcatttcatgttccgggacatcacaatggagatgtcttttttgatgacgctaagtcaatattcgatccgcttctcaccattgatgtaactgaactggcaggactggatgatctccatcatccttccggggtgattaaggaagctcaggagcttgtcagtcaattatatggatcggcggaaagtttttttctggtaaatggtacgactgtcggaaacttagcgatgattttatctgtttgtgaacctggtgatacaattctggttcaaagaaactgtcataaatctgtatttcatgctgttgatttgtccggtgctgagccggtttatcttgcacctgacgttgattcagcgatgcatgtgcctacgcatgttccgcttggaacaattaaagaggccctggaagcatatccagatgcgaaaggcttggtactgaccaatccgacatattacggacatagtgctgatttgactgagatcattactgaagcccatcattacgggattcctgttttggtcgatgaagcgcatggcgcacattttattttaggtttgccttttccggtctcagctttaaaaatgggggcagatattgttgttcagtcggcccacaaaacgctgcctgccatgacgatgggttcttatttgcatcttaacagcagctgcaggattaacagggatcgggtggcagagtatttaaaccgattacaaagcagcagcccgtcttatccgataatggcttcgttagatattgcccgcgcttatgtacagcatattatagaagaacaaaagctttctgacattctgcagcggatacaaacacttaaacaaacgtttgattcacttacaaatgcagaagctgttaaccctgctaatccactgatcatcacggacccgctgaagctcacaattcgttcaaaacgcgggcattctggctatacgctgcaaagcatattagagcgtgccaacatattcactgagcttgctgatgaaaatcaagtactgctcgttctcccattgggaggaaaacggagaataaatgctgaaaccattagaagcatcgatgaagagattgagaaaacgcctccggatcagacgtttgtttctgcagaatggggtgtgcagcctgttactgtcttgccttatccaaaaaaggtcttacattcgtttaagaaagaatatgtgagctttgaggaagcagctggccggctgaatgcagaagatatcatcccttatcctccgggtatcccgatgattatggcgggagaaagaataacaaaagaaagtgtgcaaaagctcagccgcttgatcagcatgaaaacgcatgttcaagggaatatgaaaatcaaagagaaacaactacttgtttatatagaagaggagaaatcatgagcggtttatttattacattcgaaggtcctgaaggtgcaggaaaaacgactgttctgcaggagatcaaaaacatactgacagcagaaggccttcaggttatggcaactcgagagccaggcggaatagatattgcagaacaaattcgagaggttattctgaatgagaacaatacattaatggacccaaaaacagaagctctcttatatgcggctgcaagacgccagcatttagttgaaaaagtaaaacctgctttagaacaggggtttatcgttctttgcgacagattcatagacagttctcttgcgtatcaaggatatgcaagaggacttggaattgatgaggttctgtccattaatgaatttgccattggagatatgatgccccatgtaacggtttatttttcaattgatccggaagaaggactgaagcgtatttacgcaaacggctcacgggagaaaaacaggctcgatttagaaaaactggactttcatacaaaagtacaagaaggttatcaagagctgatgaagcgatttccggaaagatttcattcagttgatgccgggcaatccaaagacctcgtcgttcaggatgttctaaaggtgatcgatgaagcgttgaaaaaaattcaattgtgacctgtttctcaatagttgatataataatgtaaacgagatcacgttgtttccaatctaaaggaggccttcacagatgaaattgatagtggcagttgtacaagatcaggacagcaacagacttttgaaaaccttaacggatcacaacttcagagtcacaaagcttgcgacgacaggaggatttcttaaatcaggcaatacaacgtttatgatcggtgtcgaggatatacgcgtcaataaagcgttgagtctcattaaagaaaacgggcagaaacgtgatcagatgattgcccctgtatctccaatgggcggaaatgctgattcttatgtcccttatccagtcgaagttgaagttggcggagcgacagtatttgtccttccagtcgatgaatttcatcaattttaaggatctgaaactgtgaaaattaataaagatatacgtacatttatagataataagcagattccctctgtgaaaacatctgagatcacagcatcatttaaaacatcaatggaaaaccaaagcagcaaaatgaagcttgatcagcttaccaggctgttatctgatatagaggcattcggaaaaaggctaacgaaatctcggaattttaaagacttagcgagatttaaaggacttgtgaaacgttttgtcaaagaagctgtggacagcggcctttcacatgaaacatcgaaaagctttgacctttacgggaacagcagaacgctgggacttgtgaaagaaatagatgacaaattgatacagcttacggaagagatgatggatcaggaaaaaccggcaattgatttgctggagcgtattggcgaaataaaaggtttattaattaacctttacacatagagagtgatacaatggtaatatcctggaaggaaatgaacgagcttcagcccagagtgatgaagcttttatataatagtattgagaaggacagactatcacacgcttatttgtttgagggaaaaaaaggaacaggcaagcttgatgccgcgctgcttcttgcaaaaagcttcttttgtctggaggatggcacggagccttgtgagagctgccgaaactgtaaacggatagagtcagggaaccatcctgatctccatcttgttcagcctgatggcttatcaatcaaaaaggcgcaaattcaagcgctccaagaagagttttctaagacaggacttgaatcgcataaaaagctgtatattatttcgcacgcagatcaaatgacagcaaatgcggcgaacagcctgctgaaatttttagaagaaccgaacaaagacacaatggccgtcctcatcactgagcagccccaaaggttattggataccatcatttcaagatgccaaacccttccttttcagcctttgcagccgaaagcaattgaagatagactgatcgaacaggacgtctcgcctcatatggcaaggcttctggccaacatgaccaataatgtagcagaagcagtcgaattaagtcgaaatgatgagtttgcagagtctagagcgaaagtgataaaattgtatgaagtcctacaccagcggaaaggacatgcttttttctttattcaagatcaatggatgccctttttcaaagaaaaaacccatcaagaaatgggtcttgatatgctcttattgatatatcgtgatgtgttgtccatccaaataggaaatgaagataaattgatttatcaagacttattccaatcaataaaacagcatgcgctacaatcaacacaacaaagcgttacgaatcagatacttgctgttttagaagcaaagaaacggcttcattccaatgtgaatgtacaaggattaatggagcacttggtgttaatgttgcaggagggataagcttgtacaatgtaattggtgtccgctttaagaaagcgggtaaaatatattattttgatccgaatggatttcatatagaacatgacagctgcgtaattgtagaaactgtcagaggcgttgagtacggccaggtcgtaattgcaaataaacaggtggatgagcatgatgtggtgcttccccttcgaaaagtgatacgtgtggctgacgagcgcgatcttctcattgtagaagaaaataaacaggaagcactatcagcatttgatatctgccaaaagaaagtgattgagcatggcttggatatgaagctggtcgatgttgaattcacgtttgatcgcaataaagtcattttttacttcactgctgacggccgagtcgactttagagagcttgtaaaggatttggcttctatctttaagacaagaattgagctgcgccaaatcggagtgagggatgaggcaaaaatgctcggaggaatcggtccttgcggaagaatgctttgctgttcaacgtttcttggagattttgaacccgtttccattaaaatggccaaggatcagaacttgtctttaaatcctacgaagatttcgggtctttgcggacgattgatgtgctgtctaaaatatgagaacgatgagtatgagacggcaaaagaacagcttccggatataggagaaatgattacgacagcaaacggtcccgcgaaggtcgtcggactaaatattctggaacgggtgcttcaggtggaactgataaaccgtgaaaaagtgatagaatatacttgggaagagctcttggaagagggcgtcgtatccgcacaaaccacagattaacgaggtgtggaaccttggataaaaaagagttatttgatacagtcattaacttagaagaacaaattggttcactgtaccggcagctgggggatttgaagcagcatatcggtgagatgattgaggaaaatcatcatttacagcttgaaaacaagcatttgcgcaaacggctggacgatacgacgcagcagattgaaaagttcaaagctgataaaaaagaatcaaaaacacagaagacagagcaaactgatataggggaaggatatgataatctggcacgtctgtatcaagaaggatttcatatctgcaatgtccactatggaagtgttcgaaaagaggattgtcttttctgtctgtcattcttaaataaaaaatagggaaaaggcttccgcataagacgggagcctttttcaaaggtactgaaaggataagaagatggtttcattacatgatgatgaaagattagactatttgctggcagaggacatgaaaatcatacaaagcccaacagtgtttgctttttcgttggacgctgtgcttctgtccaaatttgcgtacgttccgattcaaaaagggaaaatcgttgatttatgcaccggcaatggtattgtgccgctgctgctcagtacaagatcaaaagcagacattctgggagtcgaaatacaagaaaggctgcatgatatggctgttcgcagcgtggagtataataagctgcaggatcagattcagatcatacatgatgacctgaaaaacatgccggagaaacttggacataatcgatatgatgttgtcacctgcaatccgccgtattttaaaacgccgaaacaaactgaacaaaatatgaacgagcatctccgaatcgcaagacatgaaatccactgcacgctggaggatgtcatttcagtcagcagcaagctgctcaagcaagggggaaaagtagctcttgttcaccgaccgggaaggcttctggagatttttgaactgatgaaggcttatcaaatcgagccgaaacgtgtacaatttgtctatccgaagcaagggaaagaagccaataccattttggttgaaggtatcaaaggcgggcgtcctgatttgaaaattcttccgcctttattcgtttatgatgaacaaaatgaatatacaaaagaaatcaggaccattttatatggagacaaataaccatttcttctacgtcgtgaaatgtaaggacaatagctggtatgccgggtataccaacgatctgtataaacgagtgaaaacacacaatgatggaaagggcgcaaagtacacaaaagtaagacgtccggttgaattaatttttgccgagagcttttcaacaaagcgggaagctatgcaggcggaatattatttcaaaaaactaactcggaagaaaaaagagctttatatagaagaaaagcggaacaccaaggaggctgtatatgttaaggcgccaaatgagctttaatggaaagtcggacatgggaattctttacttggtcccaaccccaatcggaaatctagaggacatgacattccgggcgatcgacacgctgaaatcagtggatgcgattgctgcggaagatacgaggcaaacgaaaaagctttgtcatgtatatgaaattgaaacaccgctcgtcagctatcacgaacacaataaagaaagcagtgggcacaaaattattgaatggctgaaatcgggaaaaaacattgctcttgtcagtgatgccggtctgccgacgatttctgatcccggagcggaaattgtaaaggattttacggatataggcggttatgttgttccgctgccgggagcaaatgccgcattaacagctcttattgcttcaggtattgtaccgcagccttttttcttttacggttttctcaacagacagaaaaaagaaaagaagaaggagcttgaagcccttaaaaaacggcgggaaacgatcattttttatgaagcgcctcacagattgaaggaaaccttgtcagcgatggcagagatattaggagatcgggaaatcgctgtaacgcgtgaactcactaagaaatatgaagagtttattcgaggaaccatatctgaggtcattggatgggcaaacgaggatcagatacgcggcgagttttgtcttgtcgtagaaggaagtaataatgaagaggtagatgaggaagaacaatggtgggaaaccctcactgcgaaagaacatgtcgagcattacatttcgaaaggcgctacatctaaagaagccattaaaaaagcagcagtcgatcgcaatgtaccaaagcgtgaagtgtacgatgcttaccatattaagcaataaaaaaacgttcttgtgtcataacaagaacgttttttgtacaagaaatgattatttaaggttttgaagctggttttggatttcgctgatgatttgctcagcgccttctttactaagaaccaatttaccgcctgcaagtttaaggttatcatcagaaacttcaccagttacttggcaagtcatgtttggtttatattttttaaggatgattttttcatcatcaacatagatttcaagagcatctttttctgcgattccaagagtacgacgcagttcgataggaataactacacgtcctaattcatcaactttacgtacaataccagtagatttcataaacattctcctcccaagagatacttatttgtttaaattatatttttcttcgtcattattcgacaaaatccttaccttcatagcataacaaggtttccaataatcgtcaatcattttgtttactattgattgtaagaattagttcttatagtcagtaatgtcttagaaactaccgaaataacagcattttataaatatttaataaagctattatcctactaaaaatccttttaaatcaagactttcgaaccaaagttttttatttcatttgattatatacgacaaaattcgacacgaacagactttttttattttcattaaagatttttaattttaattattctttttcagggcgtatgtatatattcttgatcttaaaggctaagatggtatcatagataaaggataaatataaataatattcatatatgatttgcacttatcgccgctctcgtcctttgggcgggagctttttgacattctgattaggaggtttcaagatgccgcaagaaaacaatacattttacattacaacaccgatttattatccgagcggaaaattacatatcggccatgcatatacgacagtcgcgggagatgcaatggcacgttacaaaagattaaaagggttcgatgttcgctatttaacgggaacggacgagcatggacaaaagatccagcaaaaagctgaacaggaaaacattacacctcaggagtatgtggatcgcgcagcggcagatattcaaaaactgtggaagcagcttgaaatctcaaacgacgactttatccgcacaacagaaaaacggcataaagttgtcattgaaaaagtgtttcaaaagcttcttgataacggggacatctatcttgatgagtatgaaggctggtacagcatccctgatgaaacgttctacacggaaactcagctcgttgatattgagcggaatgaaaagggagaggtcatcggcggaaaaagccctgacagcggtcacccagttgaattgatcaaagaggaatcttatttcttccgcatggggaaatacgcggatcgacttctgaaatactatgaagaaaacccgacattcattcagccagaatcacgcaaaaacgaaatgattaataactttatcaaacctggacttgaggatttggcagtatcacgtaccacttttgattggggcgtgaaggtgccggaaaatccaaagcatgttgtatatgtttggattgacgcactatttaactatttaacggcactcggttatgatacagaaaatgatgagctttatcaaaaatattggcctgccgatgttcatttagtcggtaaggagattgtacgattccatactatttactggccaattatgctgatggcgctggatcttccgctgccaaagcaagtattcgcgcatggatggcttttgatgaaagacggaaaaatgtcgaaatcaaaaggaaacgttgtagatccggttacattaattgaacgctatggtttagacgagcttcgctattacctgcttcgcgaagtgccgttcggatctgacggtgttttcacgccggaaggatttgttgagcgaatcaactatgatttagcgaatgatttaggaaatctattgaatcgtactgttgcgatgatcaataagtattttgacggacaaattggttcttacaaaggtgctgttacggaatttgaccaaacgctcacttctgttgctgaagaaacagtgaaagcttatgagaaagcaatggaaaatatggagttctcggtagcactttcgactttatggcagctcatcagccgcacaaacaaatacattgatgagacagctccatgggtgcttgcgaaagatccggcaaaagaagaagaattgcgatcagttatgtatcatctcgctgaatcattgcgtatttcagcggtactgcttcagccattcttaacaaaaacacctgaaaaaatgttcgagcagctaggcattactgatgactctctaaaagcttgggacagcattacagctttcggccagctgaaagatacaaaagtacaaaaaggcgagccgttgttccctcgtttagaggcagaagaagaaattgcttacatcaaagggaaaatgcaaggttcggcaccagcgaaagaagaaacaagagaagaagagccgcaagaggtcgatcgtttacctgaaattacgattgatcaattcatggatgtagagcttcgcgtagctgaggtcattgaggcagagccagtgaaaaaagcagaccgtttattgaagctgcagcttgatcttggttttgaaaagcgccaagtggtatccggcattgcgaagcattatacgcctgaagagcttgttggaaaaaaactcgtttgtgtaacaaatctaaaaccggttaaactcagaggagagctttctcaaggtatgatccttgcaggagaagcagacggcgttttaaaggtcgtgtctatcgatcagtcgttaccaaaaggcacaagaattaaataatgataaaacaaaaggtgtttcacgtgtaacaattcgtcgaacaccttttgtgtttcgacaagaaaggagtttttcacttatgttgtttgacacacacgcgcatttaaatgcagaacaatatgatactgatcttgaagaggttattgaacgggcaaaagctgaaaaagttgaacgaattgtcgtagttggttttgaccgtccgacgattacccgtgcgatggaaatgattgaggaatatgattttatttatgcagccattggctggcaccctgttgacgctattgacatgacagaggaagacttagcgtggattaaagagctttctgctcatgagaaggtggtagcgataggggaaatgggactggattatcattgggataaatcgcctaaagatattcaaaaagaggtgtttagaaaacaaatcgccttagcgaaagaggtcaatttgcctattatcattcataaccgtgatgcaacggaggatgtcgtgaccattttaaaagaggaaggcgcaaaagctgtgggcggaatcatgcactgctttacaggaagtgcggaagtggcaagagaatgcatgaaaatgaatttttatttatcatttgggggaccggtgacatttaaaaatgcgaagaaaccgaaggaagtagtgaaggaaattcccaatgaccggctgctgattgaaacggactgcccgtttctcacaccgcaccctttccgcgggaaaagaaatgagccaagctatgtgaaatatgtggcagaacaaatcgccgaattaaaagaaatgacctttgaagagattgcttccatcacgactgaaaatgcgaaaagacttttccgtataaactgacaaaaaacgctagcgggttttgtaagagcttgtcccttacagcgtttttctataaaagttctacatgctttcttctcctcataggataggtttgtcgacaagtctttcttccgtttctcagtgtatttcaggataatgaagaggacactgagcttttgggagaaagagaagggagggttgacagccttttagatactctatataatctctccgaggagaaggaggcgtttttcatcacacaaaaaatgaaaaagctgttttccgtaaagcttagcaaaagcaaagtcattctggttgctgcttgtttgcttttggcaggaagcgggactgcgtacgcggctcatgagctgacgaaacaatcagtctcagtttctatcaatggcaaaaagaaacatatacgcacacatgcaaatacagtcggtgatcttttggagacgcttgatataaagacaagagacgaagacaagatcacacctgctaaacagacaaagataacagcagacatggacgttgtgtatgaggctgcaaaacctgtgaagcttacaataaacggggaagaaaagacgttatggtcaacagcaaaaacggtcggtgcattactggacgaacaagatgttgatgtgaaagaacaagatcaaattgatcccgcaatagatacagatatttcgaaagaaatgaagattaacatagagcccgcatttcaggttactgtgaatgatgcagggaaacaaaagaagatctggacgacttcgactacggtcgctgactttttaaaacagcaaaagatgaacataaaagacgaagataaaatcaagcctgcgttagatgcaaagctgacgaaaggaaaggctgatattacaattactcgtatcgaaaaggtcaccgatgtagttgaagagaagattgcgttcgatgtgaaaaagcaagaagacgcttctcttgaaaaagggaaagaaaaggtcgtccaaaaaggaaaagaaggcaagctaaaaaaacatttcgaagtcgttaaagaaaacggtaaagaagtgtccagagagcttgtaaaagaagaaacagctgaacaaagcaaagataaagtgattgctgtcggcacaaagcaaagcagtccaaaatttgaaacggtcagtgcttcaggtgattcaaaaacagttgtgtcccgcagcaatgaatcaacaggcaaagtcatgactgtatcatctacggcttatacggcaagctgcagcggttgttcaggacatacagcgacaggcgtcaatttaaaaaataatccgaatgccaaagtcatcgctgtggatccaaatgtcattccgctaggctccaaagtccacgtggaaggctatggatatgccattgctgcagataccggttcagcgattaaagggaacaagatagacgtctttttcccagagaaatcatcggcgtaccgatggggaaataaaacagtcaaaattaaaatcttaaattagtatatacttatgtattcagagggttttgcgccctctgtttttttcgttataatagacaaagtgcattttctgcttattagacgctcgatataagaaaaagtttcatgaatatacaaaagtttttattttgtcttggaggaaataatgaaaattaaagagatcattgtggtcgaggggcgtgacgatacggcccgcatcaaattggctgttgatgcagacacaattgaaacaaatggttcagccatcgatgatcatgtgattgaccaaatccgtttggcccagaagacgagaggcgtcattattttaacggatccggactttccgggagagaagattcgcaaaaccatctcagaggctgtacccggctgtaagcatgcatttttgccaaaacatcttgccaaacctaaaaacaagcggggaattggtgtggagcatgcatcggttgaaagcattagggcatgtttagaaaatgtgcatgaggagatggaagcgcagccgagtgacatttcagctgaggatttgattcatgccggactaataggcgggcatgcggccaaatgccgccgggaacgactgggtgatctgttgaaaatcggctatacaaatggcaaacagcttcaaaaacggctgcaaatgtttcaaattaaaaaaagtgattttatgagtgcgctcgataccgttatgcgggaggaacagaatgaataaagatattgcgacaccgattagaacgaaagagatactgaagaaatacggtttttcttttaaaaagagcttaggacagaatttcttaattgatacgaacattttaaacagaattgtcgatcacgcggaagtgacggagaaaacaggtgtcattgaaatcggcccgggaatcggggctttaaccgaacagcttgccaagcgggcgaaaaaggtcgtggcatttgagattgaccagcgactattgccgattctgaaggatacactgtcaccttacgacaatgtcactgtcattcatcaggacgtgttaaaggctgatgtcaaatcagtcattgaagaacaatttcaagattgtgatgagatcatggtagttgccaaccttccttattacgtaacaacaccgattatcatgaaactgcttgaagaacaccttccgctgaaagggattgtggtcatgctgcaaaaagaagtggctgagcgcatggcggctgatccttcatctaaggaatacggctcgctttcaatcgcggtgcagttttatacagaagccaaaacggtgatgatcgttccgaaaaccgtatttgttcctcagcctaatgtcgattccgcagtcatccgtctgattctccgagacggcccggcagtggacgtggaaaacgaatcctttttctttcagctcatcaaggcaagctttgcacagcgtcgtaaaacgctgctcaataacttagttaacaatctgcctgaaggaaaagcgcaaaaatcaacgattgagcaagtgctcgaagaaacaaatattgacggtaagcgccgaggcgaatccctgtctattgaggagttcgcagcgctgtctaacggattgtataaagcccttttctaaaagggctttttgttttgcgcaccacatggactgccgctacataggctagagaaggacctttcattcaatgataagaaaaaacttggactcagcgaaaaaaggcgctttctcaaggctctttctttcatgatgaggcttagtctatgtgtggagtgaggaacgtgcaatttcaaataggggatatggtagccagaaaatcctatcagatggatgttttgtttcgaattataggaatagagcaaacaagcaaaggaaattcaattgccattttgcatggagatgaagtcaggctgattgctgattcggatttttctgatctggtggcagtgaaaaaggatgagcagatgatgcggaaaaagaaagatgagagcagaatgaatgagtcgctcgaattgctccgccaagattataagctgctcagagaaaagcaggagtactatgcgacaagccaatatcagcatcaggagcattatttccatatgccgggcaaagtgcttcatctggatggtgacgaagcatatctgaaaaaatgcctgaatgtctataaaaaaattggagtgccggtctatggcatccattgccatgaaaagaaaatgtctgcttctattgaagaattgctcgacaaatatcgacctgatatcctggtgatcacagggcatgatgcgtattcgaagcaaaagggcggcattgatgatttgaatgcgtacagacattctaagcactttgttgaaactgttcaaacagcccgaaaaaagatccctcacttagatcagcttgttatttttgcgggggcctgccaatcccattttgaatcactcatcagagcgggtgcgaattttgcaagttcaccgtcaagagtcaatattcatgcgcttgatccggtatatatcgtcgcgaagatcagctttacgccgtttatggaacggattaatgtatgggaagtgctccgtaatacgctgacaagagagaaagggcttggaggtattgaaacaagaggagttctgagaattggtatgccttataagtccaattaacagttgaaaacctgcataggagagctatgcgggttttttattttacataatgatacataatttaccgaaacttgcggaacataattgaggaatcatagaattttgtcaaaataattttattgacaacgtcttattaacgttgatataatttaaattttatttgacaaaaatgggctcgtgttgtacaataaatgtagtgaggtggatgcaatggcgaagacgttgtccgatattaaaagatcgcttgatgggaatttaggtaaaaggctgacgttaaaagcaaacggtggccgccgaaaaacgattgagcgttcgggcattttagctgagacgtacccttctgtttttgtgatacaactagatcaagacgagaactcgtttgaaagagtttcatacagttatgctgatattttgactgagactgttgagctgacatttaatgatgacgccgcaagctcagtggcattttaacgggcagtgaaccttttgtttactgctttttgttttgcccttttttggtttccaataattttaacgaaagttccatctgatttaacaaaagataaaacagtcacatattatcgtgacgtgcacgaatggctatcacttctaaaaaaggagttgtttcgtttgggcagacgtcgtggagttatgtcagatgagtttaaatatgagctggctaaagaccttggtttttatgacacagtaaaaaatggcggctggggcgaaattcgggctcgcgatgccggtaacatggtgaagcgtgctattgaaatcgccgaacagcaaatggctcagaatcagaataaccgataaggatgtgacctgggggacgtgctgttccctggtttttttattttggatataaatacataatgggctgaatatggatatgttcatcctgtacttcaaatgtgatacaatgttcatacttatgtttagatggagaagtaggtgaaagctatgcgtattttagaaaaagcgccagctaagatcaatctgtcacttgacgtcacccgaaaacgcccggatggctatcatgaagtcgaaatgatcatgacgacaattgatttagctgatcgaattgaattgacggagcttgcagaggatgaagtgagggtttcctcccacaaccgatttgtgcctgatgaccaaagaaacttagcttatcaggctgccaagctgatcaaggacagatacaacgtgaaaaagggagtttccatcatgattacgaaggtaattccggtggctgccggtcttgccggcggaagcagtgatgcggcggcgacactcagagggctgaacagactgtggaatttaaatctgtccgcggaaacgcttgctgagcttggagcggaaattggctctgacgtttcattttgtgtctatggcggaactgcattagcaacagggcgcggcgagaaaattaaacatataagcacgcctccgcactgctgggtcattttagcgaagccgacaatcggtgtttcaactgctgaagtgtacagagcgctgaaactggatggtatagagcatcccgatgtacaaggcatgatcgaggcgatagaagagaagagttttcagaagatgtgcagccgtttaggcaatgtgcttgaatctgttacactcgacatgcatcctgaagttgcgatgattaaaaaccagatgaaacgctttggtgcagatgccgtgttaatgagcgggagcggcccgacagtatttggactggttcagtatgagtcgaaggtgcagagaatttataacgggttaagaggcttctgcgatcaagtttatgcggtgagaatgatcggcgaacagaacgctcttgattaaatccgtatgttaagttatattgatcttaaaatattcggattttgggggtaagttcatgaagtttcgtcgcagcggcagattggtggacttaacaaattatttgttaacccatccgcacgagttaataccgctaacctttttctctgagcggtatgaatctgcaaaatcatcgatcagtgaagatttaacaattattaaacaaacctttgaacagcaggggattggtactttgcttactgttcccggagctgccggaggcgttaaatatattccgaaaatgaagcaggctgaagctgaagagtttgtgcagacacttggacagtcgctggcaaatcctgagcgtatccttccgggcggttatgtatatttaacggatatcttaggaaagccatctgtactctccaaggtagggaagctgtttgcttccgtgtttgcagaacgcgaaattgatgttgtcatgaccgttgccacgaaaggcatccctcttgcgtatgcagctgcaagctatttgaatgtgcctgttgtgatcgttcgtaaagacaataaggtaacagagggctccacagtcagcattaattacgtttcaggctcctcaaaccgcattcaaacaatgtcacttgcgaaaagaagcatgaaaacgggttcaaacgtactcattattgatgactttatgaaagcaggcggcaccattaatggtatgattaacctgttggatgagtttaacgcaaatgtggcgggaatcggcgtcttagttgaagccgaaggagtagatgaacgtcttgttgacgaatatatgtcacttcttactctttcaaccatcaacatgaaagagaagtccattgaaattcagaatggcaattttctgcgtttttttaaagacaatcttttaaagaatggagagacagaatcatgacaaaagcagtccacacaaaacatgccccagcggcaatcgggccttattcacaagggattatcgtcaacaatatgttttacagctcaggtcaaatccctttgactccctcaggcgaaatggtgaacggcgatattaaggagcagactcatcaagtattcagcaatttaaaggcggttctggaagaagcgggtgcttcttttgaaacagttgtaaaagcaactgtatttatcgcggatatggaacagtttgcggaagtaaacgaagtgtacggacaatactttgacactcacaaaccggcgagatcttgtgttgaagtcgcgagactcccgaaggatgcgttagtcgagattgaagttattgcactggtgaaataataagaaaagtgattctgggagagcccgggatcacttttttatttaccttatgcccgaaatgaaagctttatgacctaattgtgtaactatatcctattttttcaaaaaatattttaaaaacgagcaggatttcagaaaaaatcgtggaattgatacactaatgcttttatatagggaaaaggtggtgaactactgtggaagttactgacgtaagattacgccgcgtgaataccgatggtcgcatgagagcgattgcatccatcacgctggatcacgaatttgttgtacatgatattcgtgtgattgatggaaacaatggtcttttcgttgcgatgccgagtaaacgcacccctgatggagagttccgcgatattgctcatcctattaattcaagcacgcgaggaaagattcaagatgccgtgttaaatgagtatcatcgtctgggtgacactgaagcattagaattcgaagaagctggagcttcttaaaaaataaccaaaaagcaaggactgctgaaagggctgacataagccttttgccggcggtccttttttaattctgatttttcaaacttagttgcactcaatagaaaattcttgcacttcatgaagtctccttgaaatcagaagatatttaggatatatttttctatggataaaagggatattggaggccaataaatggataagcggtttgcagttgttttagcggctggacaaggaacgagaatgaaatcgaagctttataaagtccttcatccagtttgcggtaagcctatggtagagcacgtcgtggacgaagccttaaaattatctttatcaaagcttgtcacgattgtcggacatggtgcggaagaagtgaaaaagcagcttggtgataaaagcgagtacgcgcttcaagcagaacagcttggcactgctcatgctgtaaaacaggcacagccatttcttgctgacgaaaaaggcgtcacaattgtcatttgcggagatacgccgcttttgacagcagagacgatggaacagatgctgaaagaacatacacaaagagaagcgaaagctacgattttaactgcggttgcagaagatccaaccggatacggccgcattattcgcagcgaaaacggagcggttcaaaaaatcgttgagcataaggacgcctctgaagaagaacgtcttgtaactgagatcaacaccggtacgtattgttttgacaatgaagcgctatttcgggctattgatctggtgtctaatgataatgcccaaggcgagtattatttgccggatgtcatagagattcttaaaaatgaaggcgaaactgttgccgcttaccagactggtaatttccaagaaacgctcggagttaatgatagagttgctctttctcaggcagaacaatttatgaaagagcgcattaataaacggcatatgcaaaatggcgtgacgttgatcgacccgatgaatacgtatatttctcctgacgctgttatcggaagcgatactgtgatttaccctggaactgtgattaaaggtgaggtgcaaatcggagaagatacgattattggccctcatacggagattatgaatagtgccattggcagccgtacggttattaaacaatcggtagtcaatcacagtaaagtggggaatgatgtaaacataggaccttttgctcacatcagacctgattctgtcatcgggaatgaagtgaagatcgggaattttgtagaaattaaaaagactcaattcggagaccgaagcaaggcatctcatctaagctatgtcggcgatgctgaggtaggcactgatgtaaacctgggctgcggttcaattactgtcaattatgatggaaagaataagtatttgacaaaaattgaagatggcgcatttatcggctgcaattccaacttggttgcccctgtcacagtcggagaaggcgcttatgtggcggcaggttcaactgttacggaagatgtacctggaaaagcacttgctattgccagagcgagacaagtaaataaagacgattatgtgaaaaatattcataaaaaataatcctaaattcggaggtttatccatgtctaatcaatacggagataagaatttaaagattttttctttgaattcgaatccagagcttgcaaaagaaatcgcagatatagttggagttcaattagggaaatgttctgtcacaagatttagtgacggggaagtccaaattaatatcgaagaaagtattcgcggatgtgattgttacatcatccagtctacaagtgaccccgttaacgagcatattatggaactgctgattatggtagatgcgttaaaacgcgcttctgcaaaaacgattaacattgttattccttattacggttatgcgcgtcaagacagaaaagcaagatcccgtgagccaatcacagctaaacttttcgctaacctgcttgaaacagccggtgcgactcgtgtgattgcacttgacctgcatgcgccgcaaattcaaggattctttgatataccgattgaccacttaatgggtgttccgattttaggagaatattttgaaggcaaaaatcttgaagatatcgtcattgtttcaccagaccatggcggtgtgacacgtgcccgcaaactggctgaccgactaaaagcgccaattgcgattatcgataaacgccgtccgcgtccaaacgtggcggaagtcatgaatattgtaggtaacatcgaagggaagactgctatcctcatcgatgacattattgatactgcaggtacgattacacttgctgctaatgcgctcgttgaaaacggagcgaaagaagtatatgcatgctgtacacaccctgtactatcaggccctgcggtagaacggattaataattcaacaattaaagagcttgttgtgacaaacagcatcaagcttcctgaagaaaagaaaattgaacgctttaagcagctttcagtcggaccgcttctggcagaagcgattattcgcgttcatgagcagcaatcagtcagctatctgttcagctaaaccatttttcgaggtttaaatccttatcgttatgggtattgtttgtaataggacaactaaaacgacaataggatggtgctgaatatggcaactttaacggcaaaagaaagaacggactttactcgttcgtctcttcggaatatccgtacttcaggacatgttccaggtatcatatatgggaaggatacgggcaacaaacctgtgtcattagacagtgtggagctcatcaaaacgctgagggacgaaggcaaaaatgcagtcattacgcttgaggtcagcggagaaaaacactcagtcatggtaacagacctgcagacggacccgttgaaaaatgaaatcactcatgctgattttcaagtagttaatatgagtgaggacattgaagtggaagttccgattcatctgaccggagaagccattggagtgaaaaacggaggcgtactgcagcagccgttatatgcacttactgtaaaggccaagccaaaagccattccgcaaacgattgaggctgatatttcaagcctcgatgtaaatgaagtactgacgattgcggatttgcctgctggcggtgactactcctttaatcatgaatcagatgaggttgtggcttcaatccttcctccgcagcagcaggaagcagctgaggtcgatgaagaggaatctgccgatgctcagcctgaaggtgaaaacgaacaataatagcttaaggcgtaaccctcccgcggttacgtcttttgtgctagaatgagaagaattatagcccgtttatgaagacgggagttatgtgactaagggaggattcgccatgcttgtgattgccggtctcggaaacccggggaagaactatgaaaatacacggcataatgtcggatttatggtgatagatcagcttgcaaaggaatggaatatagagctgaatcaaaataaatttaacggattatacggaaccggatttgtttccggcaaaaaggttctacttgttaaaccgcttacatatatgaatttatcaggagaatgtttgcggcctttaatggactactatgatgtcgataacgaagatttgacagtcatttacgacgaccttgaccttccgactggcaagatccgtttaagaacgaaaggaagcgccggagggcacaatggcatcaaatcactgatccagcatcttggaacatccgagtttgaccgtatccgcatcggaatcggccggcctgtaaacggcatgaaggtcgttgattatgtgttaggctcctttaccaaggaggaggcacctgagatcgaagaagcggttgataaatctgtgaaggcttgtgaggcttctttgagtaaaccgtttttagaagtcatgaacgaatttaacgcaaaggtataaaatgtaacaacaaagtccatactacaccaaaatgactttttcatcaggaggtcccttgtatggctttgcattattattgtcgtcattgcggagtgaaagtaggcagtctcgaatcttcaatggtatcgacagactcacttggatttcagcacttaacaaatgaggaaagaaacgatatgatttcttataaagaaaatggagatgtccatgttttgacgatatgtgaagattgccaagaggcgcttgaccgaaatccgcattaccacgaatatcacacatttattcaataaaaagctttggtgtagacactagaccaaagcgtttttctgttctcgcaggaaacagagaggaggggccatatggacaacattcaaacctttataaaagaaagcgatgactttaaatccatcatcaacggtttacacgagggcctgaaggaacagctgctcgcgggtctgtcgggttccgcgcgttctgtttttacttctgctctggctaatgaaacgaataagcctatctttctcatcacccataacttatatcaagcccagaaagtaacagatgatctgacttcacttctagaggatcggtctgtccttttgtaccccgtcaatgaactcatttcatcagaaatcgcagttgcaagccctgaattgcgggcgcagcgattagatgtcattaatagactaacgaatggagaagcgccaattgtcgttgctccggtagcggcaatcagaagaatgctgccgcctgttgaggtgtggaaaagtagccagatgctcattcaagtaggccgtgatatcgaacctgaccagcttgcctcacggctggtagaggtagggtatgagcggtctgatatggtttctgcgcccggggaattcagtattcgcggtggaatcattgacatttatccgttgacttcagagaatccggtgagaattgaactttttgacaccgaggtggattcaatccgcatctttaattcagatgatcagcggtcaattgagacccttacctcgatcaatatcggtcccgcgaaggaattaattatcagaccggaagaaaaagcgcgggcgatggagaaaatcgatagtggtcttgccgcgagcttgaaaaaattaaaagctgacaaacaaaaagaaatacttcatgcgaatatttctcacgataaagaacgcttgtctgaaggccagacagatcaggagctcgtgaagtatctctcatatttctatgaaaagcctgctagtttactagattatacacctgataatacacttctgattttggatgaagtcagtcggattcatgagatggaagaacagcttcaaaaagaagaagcggaatttatcacaaatcttcttgaggaagggaagattttgcatgacattcgtttgtcattcagcttccaaaaaatagtggctgagcaaaaacggcctctgctgtactactctttatttttgcggcatgtacaccatacgagcccgcaaaatatcgtcaatgtgtcaggccggcaaatgcagagtttccatggccaaatgaacgtgcttgcgggcgaaatggagcgttttaaaaaatcaaatttcactgttgtgttcttaggagcaaacaaggaacgtacacagaaattgtcatctgttttggctgattatgatatggaggccgccgtgacagacagcaaaaaagcgcttgttcagggacaggtctatatcatggaaggcgagctccaatcaggatttgagctgccgttaatgaagcttgccgttatcacggaagaagaactgttcaaaaaccgtgtaaagaagaagccgcgaaaacagaagcttaccaatgcagagcgcatcaaaagctattctgagcttcaaattggagattatgtcgttcatattaatcacgggatcggaaaatacctggggattgaaactcttgaaatcaacggcattcataaagactatttaaatatacattatcagggcagtgacaagctttacgttcctgtagaacaaattgatcaggtccaaaaatatgtcggctccgaaggaaaagagccaaagctgtataaattaggcggaagtgaatggaagcgggtcaagaaaaaagtagagacatccgttcaggatattgctgacgacttaattaagctgtatgccgaaagagaagcgagcaagggctatgcgttttctcctgaccatgagatgcagcgtgaattcgaatcggctttcccttatcaagagactgatgatcagctccgttcgattcacgaaatcaaaaaagacatggaaagagaacgtccgatggatcgcttgctatgcggagatgtgggctacggtaaaacagaggttgccatacgtgccgcgtttaaggcgatcggtgacggaaagcaggtagctctgctcgttccgacaacaattttggcgcagcagcactatgaaaccataaaagagcgcttccaggactatccgattaatatcggacttctcagcaggttcagaacgagaaaagaagcaaacgaaacaattaaagggctgaaaaacggaacggttgatatagtcatcgggacgcatcggctgctatcaaaggatgtcgtgtataaagatttagggctcctcatcattgatgaagagcagcgtttcggtgtaacccataaagaaaagatcaagcaaataaaagccaatgttgatgtattaacgttaacagcaacaccgattccgcgtacgctgcatatgtctatgcttggcgtaagggacctttcagtcatcgagactccgccggaaaatcgcttccccgtacagacgtatgttgtggaatataacggcgctcttgtcagagaggcgattgaacgtgagcttgcacgcggaggccaggtctatttcttgtacaaccgggtagaggacattgagcggaaagcggatgaaatttcaatgctagtccctgacgcgaaggtagcatatgcgcatgggaaaatgacagaaaatgaattagaaaccgttatgctaagtttccttgaaggagaatcagacgttctcgtcagcacaaccattatcgaaactggcgtggacatcccgaacgtcaatacgctgatcgtatttgacgccgacaagatgggactttctcagctttaccagctgcgggggcgtgtcggccgttctaaccgtgtggcgtatgcgtacttcacgtatcgccgggataaagtgctgacagaagtggctgaaaaaaggctgcaggctattaaagaattcacagagttaggttccggttttaaaatcgcaatgcgtgacttaacgattcgcggagctgggaaccttcttggtgcccagcagcatggcttcatcgattcggtcggatttgacctctattcacaaatgctgaaggaggccattgaggagcgtaaaggagacacagcgaagacagagcagtttgaaacagaaattgatgtcgagcttgatgcgtatattccggaaacttatattcaagacggcaaacagaaaattgatatgtataaacgcttcaggtctgtggcgacaatcgaagagaagaatgagcttcaagatgaaatgatcgaccgctttggaaactatccaaaagaagtcgaatacttgtttactgttgcagaaatgaaagtctatgcgagacaggaacgtgtcgagctgattaagcaggataaagatgctgtcagattgacgatttctgaagaagcaagtgctgaaattgacggacagaagctgtttgagcttggcaatcaatatggcagacaaatcggactgggaatggaagggaaaaaactcaaaatctccatacagacgaaaggccgtagtgccgatgaatggctcgacaccgtgctgggcatgctgaagggcttaaaagatgtgaaaaagcaaaccatttcatcaacgtaaattttgttactctctggtgtatattacatttgatgtgacggatactaatttcaagcgaggcggaaggtacataaagtaactgctttaggtctttcccacatgtatataccatcaaatgaaagagaggcaccagagatgaaagcaaccggtatcgtacgtcgtattgatgacttaggtcgggtcgtgattcctaaagaaattcgaagaactctgagaatcagggaaggcgatccgcttgagatttttgtagatcgtgacggagaagtgattttgaaaaagtactctccgatcagtgagcttggagactttgcaaaggagtatgcagacgcgctttacgacagcctcggccattcagtgctgatttgtgatcgtgatgtatatattgccgtgtccggcagctccaaaaaagattacttaaacaagtcaatcagtgaaatgctggaaagaacaatggatcagcgcagctccgtgcttgagagtgatgcgaaatcagtacagcttgtgaatggaattgatgaggacatgaattcttatactgtcggcccaattgtggcgaacggtgatccgataggtgctgtggtgatcttttcaaaagaccagacaatgggcgaagtagagcataaagccgttgaaacagcagctggatttttggctcgtcaaatggaacagtaggtcttattcctttcttcgaaaataggtatgtaaagaacagctctccttgggacgctgttctttttcatgcgtgccgaaaaaggaatccaagggttgggatgtggtataataacctcgtttttatttgtgccgcggtaatacgtgaaccgtattgcccctgacgttgggaaggagcttttggatggacgattcaataggcgttaaacggcattggatttggcagggggcttttgttttaattctggcaggcgtcatcacaaaaattttaagcgctgtttacagagtcccgtttcaaaacattgtcggcgatgttggattttatatatatcagcaggtatacccctttcttggtattgcggtcatgctgtccacatcaggatttccagtcattatttcaaagctgatgaatgattatagtgaaaaaaatcatcacaccatattaaaaatatcagcgttatttttgtctttaatcggtattttattatttctttgtttatatctgggtgctgttcctattgcactctttatgggggattcgcatctagccgtgttaattcaagtggccgcgtacgcgtttctgctgttcccatttgtcgcattgcttagaggcggttttcaggggcggcacgaaatgctcccttcagccttatcacagatgacagagcagtttctgcgtgttgcggtgctcttgggtttatcattttggctcgtgaaaaagggagcctcgctttatactgcgggagcggcagccgcttcaggctctcttgccggaagtttggttgcattgataatactggggtttttttggttcaaaacgaaaagagacaaccaaacggataggcaaaaagaaaatgtcatcacaacaaaagaattgacgaaaaaactgcttttatattcggttacaatttgtgtaagcagtttgctgcttttgtttatccagcttgttgatgctttgaatttatatgcattactttcgggtggtgaggcaagcgaagaagcaaaacgcctaaaggggatctatgatcggggacaacccttgttgcagctcggttcagtttttgccgtaagcattgcgacgtcactcgttccgtatatttctatggctgtaaaaaacaaagagctgaagatcatgaaagaaaaaatcacgtcatctttgaaactatgccttgtgctcggtacaggcgcatcggctgggttgatttgcattcttaagccggttaatatcatgctgtttcaaaatggagaagggacaggtgcgttacaagtatttagctgctccattttgtttgcatccttggcggtaacggcagcggcagtcttacagggagcggggtacacagtttttcctgcgatagcggtgggcgcgggtgttgcggtgaaatgggtgttaaacacacttttggttccgcgctatgggattgaaggcgcatcgcttgcgacagcggcttcctttgcggctgtcgccggccttaacttgtatcagcttcggcaaaaggaatggctcgataagcttagaggcgttttgattccgattattggatctgctcttttgatgtcagctggattgcttgcgtatacgcgtctatggacttttttgtttcctgctacaggaagaggagcggctgtgattgagagtctttctgctgttgccattggtggcgcggtgtttatttattgtatgatgagattgggaatatttacagatgaagagctgaacagtgtgccattcggcagcaagttaagcaaattcatgagaaggagagaacaaaatggcgggtaaaattacagtcgtcggacttggtgccggagacatggaccaattgacaattggtatacacaagctgctgacgaaggcagatacgctgtatgtcagaaccaaggatcatcctttaattgaggagcttgaaaaagaaacgaagaacatccgtttctttgatgatatatatgagaaacatgatcagttcgaggcggtatatgaagaaattgcggataccctctttgaagcggcgcggcgtgaggacgtggtttatgctgtgccgggacatccgtttgtcgcagaaaaaacagttcagctgctgacggagcggcaggaaaaggaaaacgttcaagtgaaagtcgcggggggacaaagtttccttgatgccacattcaatgccttgcaaattgacccgattgaaggttttcaatttgtggatgccggcacattgtccgcggatgagcttgagctcagacatcatctgatcatatgtcaggtttacgaccaaatgacggcttctgaagtcaagctgacattgatggagaagctgcctgatgattatgaggtcgtcattgtgactgcagcaggcagccgtggcgaggagatcaggacagtgccattatttgagctggaccgcaatgtcgccttgaacaacttaacaagtgtgtatattccgccgattaaagaagagaagctgctttatcacgaattctccacgttccgaagcatcatcagagagcttcgcggacctaatggatgtccgtgggataaaaagcagacgcatcagtcattaaagcagtacatgattgaagaatgttatgagcttctcgaagctattgacgaagaagacacagaccatatgatcgaagagcttggcgacgttttgcttcaggtcttgcttcacgcgcaaattggtgaagatgaaggttatttcacaattgatgatgtcataaaaggaatcagtgaaaaaatggtccgaagacatccccatgtgtttaaagatgttaaggttcaggatgaaaacgatgttttagccaattgggaagatataaaaaaggccgaaaaaaatacatctgaatcatcattactagacagcgtaccgaaaacccttccagctctttcgaaagcagctaaattgcagaaaaaagcagcgaaggtcggttttgactgggaagacgtcagcgatatttgggaaaaggtaagtgaggaaatgaaggaattttcttctgaggtttctgaagctcctcacgaacacaatcttaaagctgagtttggcgacattttgttcgcgctggtgaatgtagcccgcttctacaaaatagagccagaggaagcgctgaccatgactaatgacaaattccggagacggttctcgtacattgaggaaacagcgaaggaagagggagtcgagttggctgatatgtcccttgaggacatggacaaactgtggaatgaagcaaaagaaactgagaggagatcatagatatgagattagataaatttttgaaagtatcacggctgatcaaacggcgtacactagcgaaggaagtagctgaccaaggacgaatctctattaacggaaaccaagctaaagctagctctgacgtaaaaccgggagatgaactaacggtccgcttcggccaaaagcttgtaacggttcaagttaatgaattgaaagacacgacgaaaaaagaagaagctgcaaacatgtacacgattctaaaagaagaaaaactcggcgaataggcttgttctaaaaaaatcccctacctcatacaatgcagtaataatgctaaaagtatcgaggatatgggggctgaatagatgaattcatattatgatcaaaaaggttcttcgtctgttccggaacagcatgatgtgacaatgaaaggccggaagcatttagatatttctggggttaagcatgtggagagttttgataacgaagaattcctgctggaaacggtgatgggaatgctctccgtcagaggccaaaacctgcaaatgaaaaatcttgatgtggaaaaagggattgtttcgattaaaggcagggtatttgatttagtgtacttagacgaacaacaaggggataaagctaaagggttttttagcaagttgtttaaatgacgctgacgacacaattctatacaatgctggcgatgtccggtatgggtctctggcttggtgcttcgcttgatacataccggctctttgtcattcgtgccaaaacagccagatggctattatttattcatgatattcttttctggattgtgcaagggctgcttttcttttatgtcttgcttcatgtaaatgagggagaattcaggatttacatctttttagcggttctgctgggcgttgcgacgtatcagagcctttgcaaacgaatctatataaaaatactgaaattcgtcatttaccttgttgtttctgtttatcaattcttcaaaaaattcattcagcacgtgttatttcgtcctattgtgtggacatgcggagcgatcatctggctggcggcatttttattcaagaaaacatacagcctgataggttttctcctgctgtgtctatataaaatagtcatggttctgtgttttccgatccgttttatcgcgaaacaatgtttgaaacttcttcctgtgaaaatgcgtctaacttttagacgttattttgaaaaaggtgcaggatttctcaaaaagaagaagaaactattgataaccataagaacgaccattacacggtttttgaagaaatgaaaggaggaccgtctggtttgaatttttccagggaacgaacgataactgaaatacaaaacgactataaagaacaagtagaacggcaaaatcagctgaagaaacgaagacgcaaagggctgtacagacggttaactgtattcggcgccctagtattcctgacggcaattgtgctggcaagctctgtatggtcccaaacatcttcccttagtgcaaaagaagaaaagaaagaacagcttgaaaaagaactgaaaagtttaaagacaaaacaaacggatttaaaagaagaaatatccaaattgaaggatgaggattacgtcacagagcttgccagaagggacttattcatgtctggagacggagaaattatcttcaatgtggagaagaagagcaagtagccttgttgacacttaaatttttatttaggtataattaagcaaacgatctttttataagcctaaggaggagcactttttttatgtcgattgaagttggcagcaagttgcaagggaaaattacaggtattacaaattttggagcatttgttgaattgcctggaggctcaaccggtctcgttcacattagtgaggtagctgataattatgtcaaagacattaacgaccacttaaaagtcggcgaccaagttgaagtgaaagtcatcaacgttgaaaaagacgggaaaattggtttatctattaaaaaagctaaagaccgtccgcaagccagacctagaaatgatttccgtccgaaagaatcttttgaacagaaaatgaataagtttttaaaagacagcgaagatcgcttgtcatctttaaaacgcaatacggaatcaaaacgtggagggcgcggagcaagaagaggataacttgctgctttctataaaataaatgaagcatccgttcatcccgacggatgcttttttattatcctcatcctctttaagagtcagaaaattacaacattaaagtttctgttgacgaaagagacaaacctttgtattatataacttgtgcttagaagcacaaaacaatatggcggtgtagctcagctggctagagcgtacggttcatacccgtgaggtcgggggttcgatcccctccgccgctaccatatttgtttggcccgttggtcaagcggttaagacaccgccctttcacggcggtaacacgggttcgaatcccgtacgggtcatcctaaaaaatcggtttctcttgcagaagccgatttttttcatttttagacaacattccagaaattcttttgataaacgaatatcaaggcagaaaccgtcgaagatttctttggtattgttaccttcttttgacaaaatcctatctgtgctttcgctataatgacaggcaacgaatataacaggtgggagatgagaggaatggaaaaagcagaaagaagagtgaacgggccaatggcgggacaagctttggaaaaactccaatcgttttttaacaggggcacgaagctggtgactcatcatttgcattcactgtttttctataaaggattcatttatgttgtcatcggatttttgcttggacgggctttcatattatccgaggtgcttcctttcgtacttcctttctttggagcgatgcttcttatcagaagagacaaagcgttttatgcggttttggctgtgcttgcaggtgcgctgaccatatctccaaagcactcattgctcatactggcggcattgctggcattcttcgtattttctaaagtggctgccttcattaccgacgatcgtgtaaaagcactcccgattgtcgtgttcttctcgatggctgcagcaagagccgggtttgtttatgcccaaaatggcgtatttacaacctatgattatgtaatggctatcgttgaggctggactatcgtttatcttaacactgattttccttcagagccttccgatttttactgtgaaaaaagtgaaacaatcattaaaaatagaggaaatcatttgctttatgattcttattgcctctgttttaacggggctggccggcttgtcctaccaagggatgcaggcagaacatatattggctcgttatgttgtgttgagtttttcctttattggcggagcaagcatcggctgtacggttggggttgtgaccggcctgattcttggcttggcgaatatcggaaacctatatcaaatgagtctgcttgctttttccggtttattgggcggtttgctgaaggaagggaaaaaagcgggtgcagcaattggtttgatcgttggatcacttcttatatctttatatggtgaaggctctgccggtctgatgacaacgctctatgagtcattaatcgcagtcggcctgtttttgctcacacctcaatctattacgaggaaagtggcgagatatattccgggaactgtcgagcatcttcaagagcaacagcaatacgctagaaaaatccgtgatgtcactgctcagaaggtagaccaattctccaatgtatttcacgcgctgtctgaaagctttgcaaccttttatcaagcatcagacgaacagacagatgacagcgaagttgatctgttcttaagcaaaatcacggagcattcctgtcagacgtgctacaagaaaaacaggtgctgggtacagaactttgataaaacatatgatttaatgaaacaagttatgcttgaaacagaggaaaaagaatatgcatcaaaccgaaggctgaaaaaagagtttcaacagtattgttctaaatccaagcaggttgaagagctgattgaggatgagctcgcacatcaccatgcccatttgactctcaagaaaaaagtccaggacagcagacgccttgttgctgaacagcttttaggcgtttctgaggttatggccgacttttctcgggaaataaaaagagagcgagaacagcactttttgcaggaagagcaaatcatagaagcgcttcagcatttcggaattgagattcagcatgtcgagatctatagtcttgaacaaggaaatatcgatattgaaatgaccattccgttcagcggacatggagaaagtgaaaaaatcattgcccctatgctgtctgacattctggaagaacaaattcttgtgaaagccgaacagcactctccgcatccgaatggatacagccatgtcgcctttggatcaacaaaatcatacagggtgtccacgggagctgctcacgctgcgaagggcggcggccttgtctccggcgacagctacagcatgatggagcttggagccagaaaatatgctgcagcaatcagtgacggaatgggcaatggcgcaagagcgcactttgaaagcaatgaaacgatcaagcttcttgaaaaaatccttgaatcgggaattgatgaaaaaatagcaattaaaacgatcaacagcatactgtctctaaggacaactgacgaaatatattccacgcttgacctgtctattatcgatcttcaagatgccagctgtaaatttttgaaggttggatcgacgcctagctttatcaaacggggtgaccaggtcatgaaagttcaagcgagcaatctgccaatcggtattattaatgaattcgatgtggaggttgtgagtgaacagctgaaagcgggtgacctcttaattatgatgagtgatggcatttttgaggggcctaagcatgtggaaaatcacgacttatggatgaaacgtaaaatgaaagggttgaaaacaaatgacccgcaggagattgccgatttgcttatggaagaagtcatccgcacaagatccggccaaattgaggacgatatgactgttgttgttgtccggattgatcacaatacaccgaagtgggcatccattcctgttccggcaatctttcaaaacaaacaagaaatttcataacgcttccgtataaatcaaatttcttctggcgaagatgggaatatatgaatctgagaatcctcgtattctccaggaggaatgaatgtgaacaacggacatttaaatcaaattttgctgataacggatggctgctcaaaccatggggaagacccgcttgcaatggctgcttttgctaaagagcaggggattacggtaaatgtcattggtataatggaagaaaatcaaattgaccctgaggcaatgaaggaagtcgaagggattgcacttgccggaggaggtgtgcaccaagtcgtttatgcatctcagctttcacaaactgttcaaatggtaacaaagaaagcgatgacgcaaaccttacaaggtgtagtcaatcaagaactgaaacagattctcggaaagaatgtggaaatggaagagctttctccagaaaaacgcggcgaagtcatggaagtggtagacgagcttggagaaacggtgcatcttcaggttttggttcttgttgatacaagtgcaagtatggcgccaaagcttccaacagtaaaagaggcgctgattgatttgtctgtaagcctcaattcccgaatcgggaataacgaatttgcgatgtgtatatttcccgggaaaaaacaagaggtcgagcttgtgctgaactggacaccgaagctgcaatctctttccacactctttgcaaagctttcgacaggcggcatcacgccgacaggtccggcaattcgtgaagcgacactgcagtttgaaaaaatacgctcaagaaggggcatgctggcagatgatgaacgacgctttgacgagtttggcatgtagcctcaagccgggtacgacaatcaaaggcaagtggaatggaaacacttatacattgcgtaaacagcttggtaaaggggccaatggaattgtgtatttggcagaagcatcagatggacatgttgccttaaaggtgagtgatgacagcctgtctattacttctgaagtgaatgtcttgaaatctttctcaaaggcccagtccgttacgatggggccttctttttttgatacggatgatgcctatattcccagtgccaatacgaaagtttcattttatgcaatggaatacataaaagggccgctgcttttgaagtatgtcagtgataaaggagcagagtggatacctgtattaatgattcagttgttatccagcttatcggtgcttcaccagcaaggatggatattcggcgatcttaaacctgataatctgatcgtaactggtccgcccgcaaggatccgctgcattgatgtgggcggcacgacaaaggaaggccgggcgataaaagagtatacggagttttatgacagaggctattgggggtatggaacaagaaaggcagagccatcctatgatctgttcgcagttgccatgattatgatcaacagtgtgcataaaaaagaatttaagaaaacgaaccagcccaaagaacagcttaggtctctcatcgaaggaaacccgctgcttcaaaagtataaaaaagtgcttttttcagccttgaacggagattatcaatccgcagatgaaatgaaaaaggatatgctagacgcggggcaaaaagcagcacaaagaaaacagcctataaaagcatcaccgcagcctgtcacacgacaaagacagcaaaaaccgcgccaaggaaaaataacgaagacgcgatataccccaaaacagaaaccggctaagtcgggggggttatttgaaacaacgctgatcgtgatcagtgttttagcgctttatttcgcctatattatctttttcttaatctgaatggtgcaaactgcagagcctatgcttcttctttgcttggaggggttgaaagtgttaggatatgaatatctttaaaatacctgctcattgtgaggaggacattgtgaaaagtgtcaaagattttttaaacaaacacaatcttacgttaaaaggggcgacaatcattgtaggcgtttctggcggtccggactcaatggctcttcttcacgcgttgcatacgttatgcggccgttcagcgaatgttattgcagctcacgttgaccatcggttcagaggtgcggaatccgaggaggacatgcgttttgtccaagcttattgtaaagctgaacagctcgtgtgcgaaacggctcaaatcaatgtaaccgcatatgcacaggaaaaaggactcaataagcaggctgcagcacgtgattgccgctaccagttttttgaagaaatcatgtcgaagcaccaagcggactatctagctcttgcgcatcatggtgatgaccaggttgaaacaatgcttatgaaactggctaagggtacgcttggaacgggacttgcgggaatgcagccggttagacgttttgggacggggcggatcatcaggccgttcttaaccattacaaaggaagagatccttcactattgccgtgaaaacggtttgagctaccggacggatgaaagcaacgccaaagatgactacacaagaaacagattcagaaaaacagtgctcccgtttttgaagcaggaatctccggatgtgcataaaaggtttcagaaagtgagtgaagcactgacggaagatgagcaattcttacagtcattaacgaaagatgaaatgaataaagtaatcacaagccagtctaatacatcagttgaaatcaattcctctcaattgcttgccctcccgatgcctttacaaagaagaggagttcaactaatattaaactatctttatgaaaacgttccatcatccttttcagcccatcacattcagcagtttctcgattgggcggaaaatggcggtccttcaggagtactggactttccgaaagggctgaaggtggtcaaatcatatcagacatgtttgtttacatttgaacaatggcagtgcaaaaatgttccctttgaataccaaattagcggagctgctgatgaaacggcagtgctccctaatggatatctgatagaggcaaagcattatgcggactcgcctgaagaacatgggaatgctgtttttatcacaagtgaaaaaaaggtgcggtttcccttaacaatccggacgagaaaagctggagaccggatcaaactaaaagggatgaacggctcaaaaaaggtaaaggatatatttattgataagaaactgcctctccaagaaagagacaactggccgattgtgacggacgcaagcggtgaaattatctggatacctggcttgaaaaaatcaatttttgaagatcttgtgattccaaacagcgaccgcattgtattacaatatagacagcatgaaaagtgtagggggcaagcaaaatcatgatgaaacatgatatcgagaaagtactgatctcagaggaagagatacaaaagaaagtaaaagagttaggtgcagaattaacgagcgagtatcaagatacatttccgttggcaatcggtgtgttaaaaggagcacttccttttatggcggatcttatcaagcatattgatacatatttggaaatggatttcatggatgtatcaagctacggaaattctacggtttcttctggagaagtcaaaatcattaaagatttggatacttctgtagagggccgggacatcttaattattgaagatatcatcgacagtgggttaaccttaagttatctcgtagagctcttccgataccgtaaagcaaaatcaattaagattgttacccttttggataaaccgagcggaagaaaagcggacatcaaagcagactttgttggttttgaagttcctgacgcgtttgtagtgggttacggacttgattatgctgagcgctatcgcaatctgccttatatcggagtgttaaaaccggcagtttatgaaagctgatcggcagcctgcttccgagatggttattgtttgtattggaatgattttctatggtactattgaacatagttgtgcttactgtgggaggaggtaaggaatgaatcgggtcttccgtaataccattttttatttacttattttattagtagtaatcggggttgtgagctacttccagacctcaaatccgaaaacagaaaatatgtcgtacagtacgttcatcaaaaacctggatgacgggaaagttgatagcgtatcggttcagcctgtcagaggtgtttatgaggtaaaagggcagctgaaaaactacgacaaagatcaatactttttgactcatgttcctgaaggaaagggagcagaccagatatttaacgctttgaaaaagacagacgtaaaggttgagcccgctcaagaaacaagcggatgggtgacgttcctgacgaccatcatcccatttgtcattatctttattctgtttttcttcctgctcaatcaggctcaaggcggcggcagccgtgtcatgaactttggcaagagtaaagcgaagctgtatacagaggaaaagaaacgcgtcaaatttaaagacgttgcaggggctgacgaagaaaagcaagaacttgttgaagttgttgagtttctgaaagatccccgcaagtttgccgagcttggcgccagaataccgaaaggcgtgcttttagtggggcctccgggtaccggtaaaacattgcttgccaaggcttgtgcaggagaagccggcgtacctttcttcagcatcagcggatctgatttcgttgaaatgtttgtaggggtcggtgcttcccgtgtgcgtgacttgtttgaaaatgcgaaaaagaatgcgccttgtttgatcttcattgatgaaattgacgcagtcggacgtcagcgtggcgctggtctcggcggtggacacgatgaacgtgaacagacgctaaaccaattgcttgttgaaatggacggattcagcgctaatgaaggaattatcatcattgctgcgacgaaccgtgcggacatcttggacccagccttacttcgtccgggacgttttgaccgtcaaatcacagtggaccgcccagatgtcattggccgtgaagctgtattgaaagtccatgcgagaaacaaaccgctggatgaaacggttaacctaaaatcaattgccatgagaacaccaggcttctcgggcgctgacttagaaaacctcttgaatgaagctgcgcttgtagcagctcgtcaaaacaagaaaaaaatcgatgcgcgtgatattgacgaagcgacggaccgtgtaattgccggacctgctaagaagagccgcgttatctccaagaaagaacgcaatatcgtggcttatcacgaaggcggacacaccgttatcggactcgttttagatgaggcagatatggttcataaagtaacgattgttcctcggggccaggctggcggttatgctgttatgctgccaagagaagaccgttatttccaaacaaagccggagctgcttgataaaattgtcggcctcttgggcggacgtgttgctgaagagattatcttcggtgaagtcagcacaggggcgcacaatgacttccagcgtgcgacgaatattgcaagacgaatggttacggaattcggtatgtcagaaaaactgggaccgttgcaatttggacagtctcagggcggtcaggtattcttaggccgtgatttcaacaacgaacagaactacagtgatcaaatcgcttacgaaattgatcaggaaattcagcgcatcatcaaagaatgttatgagcgtgcgaaacaaatcctgactgaaaatcgtgacaagcttgaattgattgcccaaacgcttctgaaagttgaaacgcttgacgctgaacagatcaaacaccttatcgatcatggaacattacctgagcgtaatttctcagatgatgaaaagaacgatgatgtgaaagtaaacattctgacaaaaacagaagaaaagaaagacgatacgaaagagtaattcgctttctttctaaaaaaactgccggctgacgctggcagtttttttatgtaaattatgggctcagctgcggcttttacaatcatccaattctggtatcgatttgtttacaaatgagccgctgatcgtgtatggtattgtagaatgtttgtaaaaagtaaagtagagaaactattcaaaagtggtgatagaggttgttactggttatcgatgtggggaacaccaatactgtacttggtgtatatcatgatggaaaattagaatatcactggcgtatagaaacaagcaggcataaaacagaagatgagtttgggatgattttgcgctccttatttgatcactccgggcttatgtttgaacagatagatggcattattatttcgtcagtagtgccgccaatcatgtttgcgttagaaagaatgtgcacaaaatactttcatatcgagcctcaaattgttggtccaggtatgaaaaccggtttaaatataaaatatgacaatccgaaagaagtgggggcagacagaatcgtaaatgctgtcgctgcgatacacttatacggcaatccattaattgttgtcgatttcggaaccgccacaacgtactgctatattgatgaaaacaaacaatacatgggcggggcgattgcccctgggattacaatttcgacagaggcgctttactcgcgtgcagcaaagcttccgcgtatcgaaatcacccggcccgacaatattatcggaaaaaacactgttagcgcgatgcaatctggaattttatttggctatgtcggccaagtggaaggaatcgttaagcgaatgaaatggcaggcaaaacaggaaccaaaggtcattgcgacaggaggcctggcgccgctcattgcaaacgaatcagattgtatagacatcgttgatccattcttaacccttaaagggctggaattgatttatgaaagaaaccgcgtaggaagtgtataggaggtttagtaatggattatttagtaaaagcacttgcgtatgacggaaaagttcgggcttatgcagcgagaacgactgatatggtaaatgaggggcagagacgccatggtacgtggccgacagcatccgctgcattgggccgcacaatgacagcttcacttatgctcggcgctatgctgaagggcgatgataagctgaccgtgaaaatcgagggcggaggtccgatcggagctattgtagctgatgccaatgccaaaggagaagtcagagcctatgtctctaacccgcaagttcattttgatttaaatgaacaaggcaagcttgatgtcagacgtgcggttggaacaaacggaacgttaagtgtcgtaaaagatttaggtttgcgcgagttcttcacaggacaagtagaaatcgtttcaggagaattaggcgatgatttcacttactatcttgtgtcatctgagcaggttccttcatcagtgggcgtaggtgtgctcgtaaatcctgacaataccattcttgcggcagggggctttattattcagctgatgccgggaacagatgatgaaacaatcacaaaaattgaacagcgtctatctcaagtagagccgatttctaagctcatccaaaaaggactgacaccagaagaaattttagaagaagtcctaggcgagaaacctgagattttggaaacgatgcctgtcagattccattgcccttgttcaaaagaacggttcgaaacagccattttaggactaggcaaaaaagaaattcaagatatgatagaagaagatggacaagccgaagcagtatgccatttttgtaatgaaaagtacttatttacaaaagaagagctggaagggcttcgtgaccaaactacccgctaagctctttagcgggtttttaatttgagaaaaggggctgaaagcaggtttgaaatcaagaacaatctggaccattattttaggggcgctgttggtttgctgtattgctgttgcatatacgctgacgaaatcccaagccggcgcatcgtcatccggtgagtctattgcgactatcgggggcaagagtgtgacaagagaagaatggctgaaagaaatggaagaccagtatggtaagtcaacgcttgaagatatgatcaatgtccgagttgttgagcagctggctaaaaagaacaaccttaaaatatccaaaagcgaagttgatcgtgagtttttgctgattaaagcggtcaataattccttttacgaagatgaacatacgacggagaaagagtggaaagaccaaattcgttataatatcctccttgaggaattattaacaagggatatcgatatctcaaacaaagaattggaatcattctatcataaaaataaggaactatatcagtttgatgattcgtatcgaattcggcacattgttgtaaaagatgaagaagaagcgagagaagtcctgaaagaactgaaaggcggatcaagctttgaagctgtcgctgccgaaagatctacagacagatatacatcaccatacggcggagatttaggttttgtcacagaggcatcagacaacattccatcagcatacattgaagaggcgaaaacactcaaagaggatgaatggtctcaggaaccaataaaggtcagcaacggatatgccattatccagctgaaagaaaaactaaaggcaagaacgttctcatttgatgaagtaaaggaccagatcagacggcaaatcgcaatggatcagctaggcgataaagcgacagttaagaccctttggaaagaagccgatgtatcttggttttatggggaaaaaagtactaagtgattgacaaaaaattttgaaattgatagattatatacataataccaatacaaatagtcggaaattgaggtgtcgagaatggtacgtgtagcaaactccattactgaattaattgggaatacgccaatcgttaaattaaatcgccttgcagatgaaaacagtgcggatgtatatttaaaacttgaatacatgaaccctggaagcagtgtaaaagaccgtatcggtttagccatgattgaagcggctgaaaaagaaggaaaattaaaagccggtgatacaatcattgaaccgacaagcggaaatactggaatcgggcttgcaatggttgctgctgctaaaggattaaaagctattttggttatgcctgatacaatgagcatggagcgccgcaaccttcttcgcgcatacggtgctgagcttgtgctgactcctggcgcggaaggcatgaaaggtgccattaagaaagctgaagagcttgctgaaaagcacggatactttgtgccgcagcagttcaacaacccgtctaacccagaaattcaccgccaaacaacaggtaaagaaatcgttgagcaattcggtgatgaccagcttgacgcatttgtagccggaatcggaacgggcggaacgattacgggagcgggcgaagtgctgaaagaagcatacccttccatcaagatttatgctgttgaaccgtcagattccccagtgctttcaggaggaaaaccaggcccccacaaaattcagggaatcggagctgggtttgtgccggacatcttaaacactgaagtatatgatgaaatcttccctgtgaagaatgaagaagcattcgaatatgcccgcagagctgcacgtgaagaaggaattctcggaggcatctcatcaggtgcagcaatttatgctgctcttcaagtagcaaaaaaactcggaaaaggcaaaaaagtattggccatcattccaagtaacggcgaacgttatctaagcacgccgctgtatcaattcgattaaaaaagccaaaactcccggtccgccgggagtttttttatatttcgtgcatcaaatatgccatgtctgcgacgaatgttattcttggaagagaaattcacttttttcactaacaacattgctttacaattaaaaacaagtaaaaaagaaaatagaggaatgatacaaatggcacaacgcagaccggcaggcaaaaaaataccttttcaaaaagactcattcttacaacaatttgagaaacttgcgcaatcccgaaaacaccatgtacttctcgaaagtgcaagaggcggcagatacagtatagccggtcttgatccaattgcgactgtgaaaggaaaagacggaataactacaattaagcatggtgatgagatgctgtttaaagaaggtgatccattacgggccttccacagctggtttaaaacgctggaaacagaaacgaatcatgagttccctgactttcaaggcggggcaatcggttttctcagctatgattacgcacggtacattgaaaattttaaaatgctctcattagatgatctagaaacaccagatatttattttcttgtttttgatgatatagcagtttatgaccatcaagaagagtctctatggctgattactcatgttaatggttctgatcaggaaacagcggatgtgaagctatctgagttagagcagatgtggctgactgagcttcccgctgtctcttcgcgagagatgaaccctgaaacagatggttccttcgcggcgccatttaccgaggatgggttctcacaagctgtagagaaaatcaaacaatacattgccagtggagatgtgtttcaagtcaatctatcaataaggcagtcacagtcactgtctgcccacccatatcaaatttacaaaaccttgagagaagtaaatccttctccttatatggcgtatttagaaacacctgatttccaaatcatttgcggatcgcctgaactgcttgtcagcaaaaagggcaagctattagagacgagaccgattgcgggcacccgttccagagggaaaacaaatgaagaagacgaggcgcttgcaaacgaattgatacacaatgaaaaagaacgcgcggaacatgtcatgctggttgatcttgagcgaaatgatctgggaagagtatcacgttacgggtctgtgcgcgtaaatgaattcatggcaattgaaaaatactcgcatgtgatgcacattgtgtctaatgtccaaggtgaactgcaggatgggtatgatgctgtagatattattcatgctgtgtttcccggaggaaccattactggtgcaccgaaagtaagaacgatggaaattatagaagaacttgagccgacacgccgagggctttatactggatctataggatggtttggatataatcacgatctgcagtttaatatcgtcattcgaaccatttatgcaaccggagggcaggcatttatgcagtccggcgcaggagttgtgattgattctgttccgaagcacgaatacaaggaatcattcaaaaaagcttttgcgatgcaaagagcattagagctgagcaaagaagagacaaaaattagatgaggtgagcggagaaatgattttaatgattgataactacgattcattcacgtacaacttggtacagtatttgggcgagcttggggaagagctggttgtgaaacgcaatgacagcatcacaatcggagaaattgaagaactgtctccggactttctgatgatatctcccggaccgtgcagccctgatgaggcgggaatcagcctcgaagcaattaaacatttcgcagggaaaattcctattttcggtgtatgtctcggacatcagtccatcgcacaagtgttcggtggtgatgttgttagggcagaacggcttatgcacgggaaaacctcggatatcgagcatgacggcaaaaccatttttgaagggttgaaaaacccccttgttgcgacgcgataccactcgctgatcgtaaaacctgagacgctgccaagctgttttacagtaacagcacaaacgaaagaaggagaaatcatggctattcgccacaatgacctcccgatagagggcgtgcaatttcacccagagtctattatgacctcctttgggaaagaaatgctcagaaattttattgagacatatcgcaaggaagttattgcgtgatgatatatgtgaacggccggtatatggaggagaaagatgcagttctttctccttttgaccatgggtttttatatgggatcggtgttttcgaaaccttcaggctctacgaaggctgcccgtttttgcttgattggcatatagaaaggcttgaacgcgcgcttaaggatctgcaaatcgaatataatgtttcaaagcatgagatccttgagatgctggacaagctgcttaagctaaatgatatcaaggatggtaatgcccgcgtcagactgaacatatcagcgggaatcagcgataaaggctttgtcgcccagacgtacgataagccgaccgttttatgctttgtgaatcagctgaaaccagaaagtcttcctttgcaaaaagaaggaaaggttttatcgatacggagaaacactccagagggatcgttccggttaaaatctcatcattatctaaataatatgtatgcgaaacgggaaattggaaatgatccgcgtgtcgagggaattttcttaacggaggatggagctgttgcagagggtatcatatctaatgtcttctggagaaaaggtcgctgtatctatacgccatcgcttgataccggtattctggacggcgtcacgagacgttttatcatagaaaatgcaaagaatatcggcctggagctcaaaacgggccgatatgagctagaagctctcttgacagctgacgaagcgtggatgacgaactcggttcttgaaatcatcccgtttactaaaatagaagaagtaaactatggaagccaaagcggagaagcaacctccgctcttcaattgttatacaaaaaagaaataaagaacatgatgtatgaaaagggaggaagagcatggcgcaacacacaatagatcaaacacaagtaatccacactaagcccagcgctttatcatataaagagaagacgctggtgatgggaattttaaacgtaacgcctgactctttctcggacggcggaaaatatgacagcttggacaaggcgctgctgcacgcgaaagagatgatcgatgatggtgcccatatcattgatatcggaggggaatcgacaaggcctggcgctgagtgcgtatctgaggatgaggagatgtccagagtcattccggtgattgagcggattacgaaagagcttggtgttcctatttctgtagacacgtacaaggcttctgtcgcagatgaagcagtgaaagccggcgcatccattatcaatgatatttggggagccaaacatgatccgaagatggcttccgttgcagctgaacataatgttccaattgttctcatgcataaccgccctgaaagaaactacaatgacttattgccggatatgctgtcggacttaatggagagtgtaaaaattgctgttgaggccggagtagacgagaagaacattattcttgatcctggtatcggtttcgcgaaaacctatcacgataacttggcagtgatgaacaaactagagattttcagcgggctgggatatccggttcttctggcaacctcccgaaaaagattcatcggacgtgttctggatcttccgcctgaggagcgggctgagggcacaggcgcgactgtgtgtctcggcattcaaaaaggctgtgacattgtcagggtccatgatgtaaaacaaattgccagaatggcgaaaatgatggacgcgatgctgaataagggaggggtgcaccatggataaagtttatgtagaaggtatggagttttacggatatcacggtgtgttcaaagaagaaaacaaacttggccagcggtttaaagtcgatttaaccgctgagctggatttaagcaaggccggacaaacagacgaccttgaacaaacaatcaactatgctgagctctatcacgtatgtaaagatatcgtggaaggggagcctgtaaaattggtggaaacgctggcagaacgtattgctgacactgttctcggaaaatttcagccggttcagcaatgtacggtgagagtgattaagccagacccgccaattcccggacactataaatcagtagcaattgaaatcacgagaaaaaagtcatgaacaacatagcttatattgcacttggatctaatattggagatagagaaacgtatttaaggcaagcagtggctttactgcatcagcatgctgcggtgacagtcactaaagtgtcgtctatttacgaaactgaaccggtcggatacgaagatcaagctgaatttttgaatatggctgttgaaatcaagacatcactgaacccttttgaactccttgaactgacgcagcagatagaaaatgaattaggcagaacaagggaagtaagatgggggccgcggacggcagaccttgacattttgttatttaatcgtgaaaatattgaaacagagcaactaattgttccgcatccgagaatgtatgagcgtttgtttgtccttgcgccgcttgcggaaatttgccagcaggttgaaaaagaggctacaagcgccgaaacagaccaagaaggtgtaagagtatggaagcagaaatctggggtagacgaattcgtgcattcagaaagctgaaaggttatactcaagaaggatttgcaaaagcattaggtatatcagtttctattctcggcgaaattgaacgcggaaaccgattgccgtcagctgccatcattcaagatgcagcagatgttttaaatataagtgcggacgaattggcgccgccagaaaaatagaacaaatgaaaggaggagaaaaattgttcaaaatcggagatattcaattgaaaaaccgggttgtgctcgcacctatggctggtgtctgcaactctgcgttcagattgactgtaaaggaatttggagccggattggtatgcgctgaaatggtcagtgacaaagcgatcctttacaacaatgcaagaacaatgggtatgctttatattgatgaacgtgagaaaccactgagccttcaaattttcggaggaaaaaaggaaacccttgtggaagcggcgaagtttgtagaccaaaacacaactgctgatatcattgatattaacatgggatgtcccgtgccgaagattacaaaatgcgatgcgggagccaaatggcttctcgaccctgataagatttacgaaatggtttctgcagtagtggatgctgttaataagccagttacagtgaaaatgagaatgggctgggatgaagaccacattttcgcagtgaaaaatgcacaggctgtagaacgtgcgggcggtaaagcagttgcgcttcacggccgtacgagagtgcagatgtacgaaggaacggcaaactgggatatcatcaaagaagtaaaacaatcagtatcgattccggttatcggaaacggcgatgttaagacaccgcaggatgctaagcgtatgctcgatgagacaggagtagacggggtcatgatcggacgcgctgcattgggcaacccgtggatgatttaccgtacggttcagtatcttgaaacaggtgaattaaaagaagagccgcaagtacgcgaaaaaatggccgtatgcaaactgcatcttgaccgcctgattgacttaaaaggtgaaaacgtagcggtaagagaaatgagaaagcacgctgcatggtatctgaaaggcgtgaaaggcaatgcgaacgttcgtaatgaaatcaatcattgcgagacgagagaagagtttgtacagcttttagatgcatttacggttgaagttgaggcaaaagagcttcaaaatgcaaaagtaggataatactcacctctatttgctgctcgctgctagttttacgctggcagtttttctgcttttttcatgaaacaatatctgtaatggagtgataacaatgagtcaagaagagcataaccatgaagaattgaacgatcagctgcaagtcagacgcgataaaatgaatcagctgagagataacggcatcgatccattcggcgcacgttttgaaagaactcatcagtctcaagaagttatttcggcatatcaagatctaaccaaagaagagttagaagaaaaagcgattgaagttacaatcgcaggccgcatgatgacaaaacgcggcaaaggaaaagccggctttgcccatcttcaggatttagaaggccaaatccaaatctacgtaagaaaagacagtgtcggtgacgaccaatatgaaatcttcaagtcttctgacctcggtgatcttatcggcgtaaccggaaaagtcttcaaaactaatgtaggcgaattgtctgttaaagcaacttcctttgaattgctgacaaaagcgcttcgtccgcttcctgacaaataccatggtttaaaagacgttgagcagcgctaccgtcagcgctacctggatcttatcgtaaacccagacagcaaacatacgttcattacacgaagcaagatcattcaagctatgagaagataccttgatgatcatggatacttagaagtagaaacacctacaatgcacagcattcctgggggagcttctgcgcgtccgtttatcactcaccacaacgcgttagacattccactctatatgcgtattgctatcgaactgcacctaaaacgtctaattgtcggcggtttagaaaaagtatatgaaatcggccgtgttttccgtaacgaaggtgtctctacacgccataaccctgaatttacaatgattgagttatatgaagcatatgcggactataaagatatcatgagcttaactgaaaaccttgtcgctcatatcgcccaagaagtgcttggcacaactacgattcaatacggggaagagcaaatcgaccttaaaccggagtggaaaagaatccatatggttgacgcagtcaaagaagcgaccggcgttgatttctgggaagaggttactgttgaacaggcgcgtgaatatgcaaaagaacatggtgtagaaattaaagattctatgacagtaggccatatcatcaacgaattcttcgagcaaaaaattgaagaaacgcttattcagccaacgtttatttacgggcatcctgtagaaatttctcctcttgctaagaaaaaccctgaggacccgcgttttacagaccgttttgaactgtttatcgttggccgtgaacatgccaacgcgtttacagagctgaatgatcctattgatcaaagagaacgctttgaagcgcaattaaaagagcgtgaagccggtaatgatgaagctcatctaatggatgaagactttgttgaagctctggaatacggtatgccgccaacaggaggtttaggcattggtatcgaccgtctggttatgctgctgacgaatgccccttctattcgcgatgtgctgttattcccgcaaatgagacaacgctaataaggaagagcggtatcctccatagggaaaagatgccgctctttttaaattccttagtatttcttcaaaaaaactattgcactattatttactaggtggtatattattattcgttgccgctaaacaaggcgataacgaaaaaaaggacttcaaaaaaagttattgacttcactgagtcaacgagttataataataaagtcgcttgaacgaagtgaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttgcagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattttacggaatataagaccttgggtcttataaacagaacgttccctgtcttgtttagttttgaaggatcattccttcgaaacgtgttctttgaaaactagataacannnnnnnnnnnnnnnnagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacagctgttatctagttttgagagaacactctcaatttgtttggtggcgatagcgaagaggtcacacccgttcccataccgaacacggaagttaagctcttcagcgccgatggtagtcggggggttccccctgtgagagtaggacgccgccaagcaattgcacgttagtgcaattatggaggattagctcagctgggagagcatctgccttacaagcagagggtcggcggttcgagcccgtcatcctccaccattatgccggtgtagctcaattggtagagcaactgacttgtaatcagtaggttgggggttcaagtcctcttgccggcaccacttttatatgatataatactcaagtctcttgtagaagagccattagctcagttggtagagcatctgacttttaatcagagggtcgaaggttcgagtccttcatggctcaccattttacgcgggtgtggcggaattggcagacgcgctagacttaggatctagtgtctttatgacgtgggggttcaagtcccttcacccgcattatataggataacagttagaaaaactggacatcctgtctgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattatgttttgcgcccgtagctcaattggatagagcgtttgactacggatcaaaaggttaggggttcgactcctctcgggcgcgccatatcttttaatagaatagataggaaatcgggaagtagctcagcttggtagagcacatggtttgggaccatggggtcgcaggttcgaatcctgtcttcccgaccatttttttatggggccttagctcagctgggagagcgcctgctttgcacgcaggaggtcagcggttcgatcccgctaggctccaccaaaagtttttaaaaaagttgttgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattttacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggatcagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagctttggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacagctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgtattttggtttattggtatcataaaattccacttaactgtataatataataactttataccgaattttaaatcagcaatcaggttttgtggaccgggaaaatggaaataataaaggatagagcgagaaagttgaaaattctcgagaaacggcttatagtaagattatagtcaaatatagtcaaagtcagtaaaggagggggttgagtgggacataatatttctgacatcattgaacaatatttaaaacgagtgttagatcaaaatggcaaggaaattttagagattaaacgaagtgaaattgcagataaatttcaatgcgttccttcccaaataaattatgtcatcaacaccagatttacaagcgaaagaggatatattgttgagagcaaacgcgggggcggcggttacatcagaatcattaaaattaaaatgaacaatgaagttgtcctgatcaataatataatttctcaaattaatacccatttgtctcaagcagcctctgatgacattattttaaggctattagaagacaaggtaatttcagaaagagaagcaaaaatgatggtcagtgtaatggaccgctcagttttacacattgacttacctgaacgtgatgaattaagagcgagaatgatgaaggcaatgctgacttctttaaaattaaaataagcgggtgaaaagattgatttgtcaagagtgccacgagagaccagccacttttcactttacaaaggttgttaacggagaaaaaatagaagttcatatttgtgaacaatgtgccaaagaaaatagtgattcatatggtataagtgcaaatcagggtttctctattcataatttactttcgggtttactgaacatggattcttcatttcaaaatgcaggaactcaaatgttcagtcactcggagcaaatatctgcttgtccgaaatgcggaatgacttttcagcaattcagaaaaattggccgttttggatgttcggaatgttacaaaacatttcatagcaacattacaccaatcctacgtaaagtgcacagcggaaacactgtgcatgcaggtaagataccgaaacgaataggcggcaatcttcatgtcagacggcagattgatatgctaaaaaaggaattagaatccttaatccatcaagaagaatttgaaaatgcagctcatgtaagagatcaaattcgttcattagaacaatcactcaaaagtacagatagtgaggaggaacaggagtaatgtcgctaaagcattttattcaggacgcactaagcagttggatgaagcagaaaggacctgaaagtgacattgtactcagcagccgcatacgtttagcaaggaactttgagcatattcggttccctacgcggtattccaatgaagaagcctcatccatcatacagcaatttgaagatcagttttcagagcaagaaattcccggaatcggcaaatttgttttgattagaatgaatgatgcacagcctttagagaagcgtgtacttgttgaaaaacatctaatcagtccgaatctgacagagtctccttttggcggctgtttgctttctgaaaatgaggaagtaagcgtcatgctaaatgaagaggaccatattagaattcagtgtcttttccctggatttcagcttttagaagcaatgaaagccgcaaaccaggtcgacgactggatcgaagaaaaagttgattatgcattcaatgagcaaagaggatacttaaccagctgtcctacaaacgtaggtacaggtttaagggcttcggtcatgatgcatctgccggcactggttttaactaggcaaataaatcgaattataccggcaattaatcaattaggcttagttgttagaggaatttatggggaaggcagcgaagcagtagggaatatctttcaaatttcaaatcagatcacgcttggtaagtcagagcaggatattgtagaggatcttaacagtgttgctgctcagttgattgaacaagaacgatccgcccgagaagcgatttatcaaacttctaaaatcgaacttgaggatcgggtatatcggtcttatggggtcttgtctaattgccggatgatagaatcgaaagaaactgcaaagtgcctttcagatgttcggttaggcatagacctaggcattataaaaggactttcaagcaacatacttaacgaacttatgattttgacgcagccaggatttttacagcaatactcgggaggcgctttgcgtccgaacgaaagggacattcgaagagcggctctcatcagagaacggcttcacttagaaatgaatgggaaaagacaggaggatgaatcgatatgatgtttggaagatttacagaacgagctcaaaaagtactggcgctagcacaggaagaagcacttcggttaggtcataataacattggcactgagcatattttattaggactggtaagagaaggagagggcattgctgctaaagctcttcaagcgcttggactcggttcagataaaattcagaaagaagtagaaagtttgatcgggcgcgggcaggaaatgtctcaaacgattcattatactcctagagctaaaaaagtcattgagctttcaatggatgaggcaagaaaactcggtcattcttatgttggaacagaacatattcttcttggtctgattcgtgaaggagaaggtgttgctgcgagagttctgaataatctcggtgtcagcttaaataaagcaagacagcaggtgctccagcttctaggaagtaatgaaacaggatcatcagcggcaggaacaaacagcaatgcgaatacgcctactcttgacagcttggcaagagacttaactgctattgcgaaggaagacagccttgaccctgtaatcggcagaagcaaggagatccagcgtgtcattgaagtgttaagccgcagaacgaaaaacaaccctgttctcattggggaaccaggtgtaggtaaaacggctatcgcagaaggtttggcacagcaaattatcaataatgaagtacccgaaattttgcgtgataaacgtgtgatgacattagacatgggaacagttgttgccggcacaaaataccgcggagaatttgaggatcgcctgaagaaggtcatggatgaaattcgccaggcaggaaatatcattctattcatcgatgagctccatacattaatcggggcaggcggagcagaaggtgctattgatgcatctaatattttaaaaccttcacttgctcgtggcgaactccaatgtattggtgcaacgactcttgatgagtaccgtaaatatattgaaaaagatgcagcactggaacgccgttttcagccgattcaggttgatcagccatctgtagatgaaagtattcaaattttacaaggtctgcgtgacagatacgaagcccaccaccgcgtttctatcactgatgatgccattgaagctgcggttaagctttctgacagatatatttctgaccgcttccttccggataaagcaattgacttgatcgatgaagcaggttcaaaggtgagactgcgctcatttacaacgcctcctaacttaaaagagcttgagcagaagcttgatgaggttcgtaaagagaaggatgcggcagtgcaaagccaagagtttgaaaaagctgcttccttgcgtgatactgaacaacgcctgcgcgagcaagtagaggatacgaagaaatcatggaaagagaagcaagggcaggaaaactcagaggttactgtggatgatattgcgatggttgtatccagctggaccggtgtgcctgtatctaaaatcgcccaaactgaaactgataagcttctcaatatggaaaacattcttcattcccgcgtcatcggccaggatgaagcagttgtagctgttgcaaaagccgtcagacgtgcgagagcaggattgaaagatcctaaacgcccaatcggctcattcattttcttaggccctacaggtgtaggtaaaacagagcttgcacgagcactcgctgaatccatttttggtgatgaagaatccatgatcagaattgatatgtctgaatacatggaaaaacactcaacttcaagacttgttggttcacctccggggtatgtgggatatgatgaaggcggtcaattgacagagaaagtcagaagaaaaccttactctgtcgtgcttcttgatgagatcgagaaagcgcaccctgatgtcttcaatatccttctgcaagttcttgaagacggacgattgactgattctaaaggacgcacagtcgatttccgcaataccattctgatcatgacatcaaacgtcggagcaagtgagctgaaacgcaataaatatgtcggctttaacgttcaggatgaaactcaaaatcataaagacatgaaagacaaagtgatgggtgaattaaaacgagcgttcagacctgagttcatcaaccgtatcgatgaaatcattgtcttccattcacttgagaaaaaacatcttactgaaattgtgtcattaatgtctgatcaattaacgaaacgcttgaaagaacaagatctttctatcgaattgacagatgctgcaaaagcgaaagtcgcggaagagggcgttgacctggaatacggtgcccgtccgttaagaagagcgatccaaaaacatgtcgaggatcgtttatctgaagaactcctcagaggaaatattcataaaggacagcatattgttcttgatgtagaagatggcgaatttgtcgtaaaaacgactgctaaaacgaattaatatagaagacggaaatgaggcatacagcatgtaagtgtatgcctcactttcatatcaagaaatagaacaagggagaggtcttacactatatatggctaaaacaaaatcgaaattcatctgccaatcctgcggctacgagtctccaaaatggatggggaaatgtccgggctgcggtgcttggaatacaatggtggaagaaatgattaaaaaagcaccggccaatcggagagcggctttttctcattctgttcaaactgtacagaaaccttcacctattacatcaatcgaaacatcagaagaaccccgcgtcaaaacccagcttggcgagtttaacagagtactcggcggaggtgtcgttaaaggctccctcgttttaattggcggtgatcctggtatcggaaagtcaacgctattactgcaggtttccgctcaattatcaggctcatcaaacagtgtcctgtatatttcgggagaagaatctgtaaagcaaacgaagctgcgagcagaccgtctgggcattaataatccgtcactgcatgttttatctgaaaccgatatggagtatatttcgtctgctatacaagagatgaatccagcgtttgtcgttgttgactctattcaaacggtttaccaaagcgatattacatcggctccaggcagtgtgtcacaggtcagagaatgtactgctgagctgatgaaaatcgcaaaaacaaaaggtattccgatttttatcgtagggcacgtgacgaaagaagggtctattgcaggtccgagactgttggagcatatggttgacactgttttatattttgaaggagaacgccaccatactttccgtattttgcgggctgtaaaaaaccgtttcggatctacaaacgaaatgggcattttcgaaatgcgggaagaggggctcactgaggttttgaatccttcggaaattttcttagaagaacgctctgctggttccgcaggctcgagtatcactgcctctatggagggcactagaccgattctcgttgaaattcaggcgctcatctcgccaacaagctttggcaacccaaggcgtatggcaacgggaatagaccataacagggtttctctgttaatggctgtgttagaaaaaagagttggactgctgctgcaaaatcaggatgcttatttgaaagtggctggcggcgttaagcttgatgaaccggcaattgatcttgcgattgtgattagtatcgcatcaagctttagagacacacctccaaatcctgcagattgttttattggagaagtgggattaaccggagaagtccggcgggtttcaagaattgaacagcgtgtgaaagaagcggcaaagcttggctttaaacgcatgatcatacccgcggcaaatctggacggatggacaaaaccaaaagggattgaggttatcggagtagcaaatgttgcagaagcgcttcgtacttcattaggaggataatagatggaaaaagagaaaaaaggggcgaaacacgagttagacctgtcatctatattgcagtttgttgctccgggtacaccgctcagagcggggatggaaaacgtcttgagagcaaatacaggcggtctgattgttgttggatataatgataaagtaaaagaagtggtggacggcggctttcacataaacacggctttttctccggcgcatttatatgagctggctaaaatggatggagcgatcattttaagtgattctggtcaaaagatcctctacgcgaatactcagctgatgccggatgccacaatttcttcatcagaaacaggaatgcggcacagaactgccgaaagagtagctaagcaaactggctgtcttgtaatcgctatttctgaaagaagaaatgtcataacgttatatcaggaaaacatgaagtatacactaaaagacataggatttattttaaccaaggcgaaccaagccattcaaacacttgaaaaatataagacaatcctcgataaaacgattaatgcactgaacgcgttagagtttgaggaacttgttaccttcagtgatgtcttgtctgtcatgcatcgttatgaaatggtactgagaatcaaaaacgaaattaatatgtatatcaaagagctggggacagaagggcatctgatcaaactgcaagtcattgaattgattacggatatggaagaagaggccgctttatttattaaggactatgtaaaagaaaagattaaagatccgtttgttctcttgaaggagctgcaggatatgtccagttatgatctgctggatgattccattgtgtataagcttctcggttaccctgcttctactaatcttgatgattatgtattgccgagaggatacaggctgttaaataagataccgcgtcttccgatgccgattgttgaaaatgttgtagaagcatttggagtcctaccaaggattattgaggcgagtgcagaagaattagatgaagtagagggaatcggtgaagtacgagcccaaaaaatcaaaaaaggattaaaacgtctgcaagagaagcattatttagacagacaactgtgatttcggttaaaaccttatgaatacgggtatattaatgttggtttttgtttattctgatattcgtaggatgcataagactttgtgaaattaaaatgttaaaaaaggaggtgggggtatgttaaaacgaatagttcaggcgttcttcattatttttggcggcgttgttggtatatttttgatacctgaattgtttgtactgttaaatatacaggacatacctttaataacaaacgcatatacgtctgcggcaataggagcaattatcttttttctcatcagtatatggggtacagaatacgttgtgaactgggtgaagtggatagaggattcattgttaaaagcgccggttccagatttgttatttggaagtcttggcttagtttttggacttataattgcttatcttatcgtaaatgttattcctttagacaatataccttaccgcatattcagcacaataattcctgtatttttggctttcttcctcggttatctcggcttccaggtgggctttaagaaaaaggatgaattgatcagcctgttttccatttccgccagaatgcaaaagaaaaaaggaacagctgatgaagaacatgaggttcaagacaagaagctgaaaattttggacactagtgttattattgatgggagaatagcagatatttgtcagactggttttttagagggagttatcgtgattccgcagtttgtccttgaggaattgcagcatattgcagactcttcagatgttttaaaacgaaacagaggacgccgcggtcttgatatcctgaaccgcattcagaaagaattagacattgaagttgaaatttacgaaggcgactttgaagatattcaggaggttgacagcaagctcgtcaaacttgctaagctgacatccggggtcgtcgtgacgaatgattttaatttaaataaagtgtgcgagcttcagaaggtagcagtattaaacattaatgaccttgccaatgcggtcaagcctgttgtgcttcctggcgaggaaatgaatgttcaggtcattaaggacgggaaagagcataatcagggagttgcctacttggatgacggtacgatgattgtcgttgaagaaggacggaattatatcggcaagcatattgatgtacttgtcacaagtgtgctgcagacagcagcgggacgaatgatttttgcgaagcctaagctgttggagaaggcgctctaaagggagaagaaacaatgagttatgatgtggtgattcctgcagccggacagggaaagcggatgaaggcagggagaaataaactgttcattgagctgaaaggagacccggtgatcatacacacgttaagagtgtttgacagccaccggcagtgcgataaaatcattttggtgattaacgaacaggagcgggagcactttcagcacttgctgtccgattacccgtttcaaacttcaattgagcttgttgcaggcggagatgagcgtcagcacagtgtgtataaggggctgaaagccgtaaagcaggaaaagattgtccttgtacatgacggtgcccgcccatttataaaacatgaacaaattgacgaactgatcgcagaggcggaacagacaggagcggccatccttgctgttccggtaaaagatacgattaaacgcgttcaagatttacaagtcagtgagacgattgaacgttcaagcttgtgggctgtccaaacgccacaagcttttcgtctttctttattgatgaaggctcacgctgaggccgagcgcaagggatttttagggacggatgacgccagcctcgttgaacagatggagggcggttcggtccgtgttgtagaaggcagctatacaaatattaagctgacgacgccagacgatttgacgtcagctgaagctatcatggaatcagaaagtgggaataaacatgtttagaattggacaaggatttgatgtgcatcaattagtggagggccgtcctctcattattggcggaattgaaatcccgtacgaaaaagggctgcttggccattctgatgcagacgtattgctgcatactgtcgctgacgcctgcctgggagctgtgggtgaaggagacatcggcaagcattttcctgacacagatcccgagttcaaggacgcagattctttcaaattacttcagcatgtctggggaatcgtgaaacagaaggggtatatccttgggaacattgattgcaccatcatagcgcaaaagccgaagatgctgccgtacatagaagatatgagaaaaagaattgctgaaggccttgatgcagatgtttctcaagtaaatgtaaaagcaacaacgacagaaaagcttggatttacaggccgggcggaaggaatagcggctcaggcgacagtactgatacaaaaaggctaacttgttttgatgccgggtctatttggtggtagaatagattcatacatttttgcctgaggccatacatgacatgaaaggaagtatttgaaaatgggaaacgaagtacgcgtccgttatgcaccgagtccaaccggacatttgcatattggaaatgccagaacggcgctttttaattatttatttgcccgcaatcaaggcggtaagtttatcattcgagttgaggatacagataaaaagcgcaatattgagggcggagaacaaagccagctgaattatctgaagtggctaggtattgactgggatgagagtgtggatgtcggaggagagtacggcccataccgtcagtcagagcgtaacgatatctataaagtgtactatgaagagcttcttgaaaaagggcttgcttataaatgttactgtacggaagaagagcttgaaaaagagcgtgaagaacagattgcccgcggagaaatgcctcgttattctggaaaacacagagacctgactcaggaagaacaggagaaatttatcgctgaaggcagaaaaccaagtattcgtttccgcgtgccggaaggaaaaatcatcgccttcaatgatatcgtaaaaggcgaaatttcttttgaatcagatggcatcggcgactttgttattgtgaaaaaggacggaacgccgacttacaacttcgcggtagcgattgatgactacttaatgaaaatgacacacgtgctgcgcggtgaggatcatatttctaacacaccgaaacagattatgatttatcaagcattcggatgggatattcctcagttcggacacatgacgctgattgtaaacgaaagccgtaaaaagctcagtaaacgtgatgaatccattattcaattcatcgagcagtacaaagagcttggctacctgccagaagcgctgttcaactttatcggactgctaggctggtcaccggttggagaagaagagcttttcacaaaagagcagtttattgaaatttttgatgtaaatcgtttatctaaatcaccagctttgtttgatatgcataagctaaaatgggttaacaaccaatatgtgaagaagctggatcttgatcaggttgttgaactgacgcttccgcatttgcaaaaagcgggcaaagttggcactgagctttctgctgaagaacaagagtgggttcgtaaactgatttccctgtatcatgagcaattaagctacggtgcggaaattgttgagctgactgatttgttctttacggatgagatcgagtataatcaagaagcgaaagctgttctggaagaagaacaggttcctgaagtgctcagcacattcgcagcgaagcttgaagagcttgaggagttcactccggataacatcaaagcatcaatcaaagcagtgcagaaagaaactggccataaagggaaaaaactgtttatgccgattcgtgttgctgtaacagggcaaactcacggtccggaactgccgcaatcaattgaattgatcggtaaagagactgcaattcagcgtttaaaaaatatctaaataaatgattgttgacagggaagagtataaagctttaggccattacagaaaggatctccattggctgagagagatccatgagccgggttttagaagtgcgcccttaagacctttgaagaacgttttttgaaaccagtattcaaaggcggccgccgccgttacaggctgaagttgggagagcagaagtctgcttttcaaacagagtggaaccgcgcggttaaagcgtctctgtcatgtttacatgcagagacgctttttttattgggtagaggaaatcagatagagaaacggggggaagcatgtgttttttagaatgctcaaagaagacattgatactgtgttcgatcaagatcccgcagcaagaagctattttgaagtgattttaacttattccggtttacatgctatatgggcgcatcggattgcacatgctttatataaacgaaaattttatttccttgcacgccttatatctcaagtaagccgattttttaccgggatagaaatccacccaggcgctacaatcgggagaagatttttcatagaccacggcatgggggttgtcattggggagacatgtgaaatcggcaataacgtaaccgtttttcagggggttaccctcgggggaacggggaaagaaaagggaaaaaggcacccaacgattaaagatgacgcattgatagccacaggtgctaaagtgctcggttctattacggtcggtgaaggctcaaagattggcgctggttcagtagtgctgcatgatgttcctgatttttcaacagttgtcggtatccctggacgggtcgttgtacaaaatggcaagaaagtaagacgcgatttaaaccatcaggatttgcccgatccagttgctgaccgctttaagtctttggaacagcagattttagagctgaaggcagaacttgaagacagaaaagaaaggatcaatcaaaaatgacaatcacactttataatacattgactagacagaaggaaacattcgttcctcttgaagagggaaaagtgaaaatgtatgtatgcggacccacggtttacaattacattcatatcgggaacgcgcgtccggcaatcgtttacgatacggttcgaaactatttagagtataaaggctatgatgtgcagtatgtctctaactttacagacgtagacgataaattaattaaagcggcaaatgaactcggtgaggatgtacccaccatttcagagcgttttattaaagcatactttgaagacgtgggtgcgctcggctgccgaaaagccgaccttcatccgcgagtaatggagaacatggatgccattatcgaattcgtagatcagctcgtgaaaaagggctacgcatatgaatcagaaggtgacgtatatttcaaaaccagagcgtttgaagggtacggaaagctttctcagcaatcaatcgatgaacttagatcaggtgcacgcatccgagtcggcgagaaaaaagaagatgctcttgatttcgcactgtggaaagcggcaaaagaaggagaaatctcttgggatagcccttgggggaaaggacgtccgggctggcacattgaatgctcagcaatggtgaaaaagtatctcggtgaccagattgatatccatgcgggcggacaggatttaacattccctcaccatgaaaacgaaattgcgcaatctgaggcgctgacaggcaaaacgtttgcgaagtactggcttcataatggttatatcaatattgataatgaaaaaatgtcaaaatcactaggcaactttgtgcttgtccatgacatcattaaacagcatgatccgcagcttttgagattctttatgctatctgttcattatcgccatccgattaactattcagaagagcttctggagaatacgaaaagcgcgttcaaccgcttaaaaacagcgtacagcaatcttcagcaccgtcttaacagcagtacgaatttaaccgaagatgacgatcaatggcttgaaaaagttgaagaacaccgcaaagcattcgaagaagcgatggacgatgattttaatacggcgaatgccatttcagtcttgtttgacttagcgaaacacgccaattattatcttcagaaagatcatacggctgatcatgtgattacggcgtttattgagatgtttgaccgcattgtttctgtccttggtttttcgttgggtgagcaggaacttctcgatcaagagattgaagacttaatcgaaaagcgaaatgaagcgcgccggaatcgcgattttgcattgtcagaccagatccgcgaccagctgaaaagcatgaatatcattcttgaagatacggctcaaggcactcgctggaaacggggagaataacagatgcttgaatttgatacgataaaagattctaagcagcttaacggtcttgcgcttgcttatataggtgatgccatttttgaagtgtatgtcaggcatcacctgcttaagcagggctttaccaaaccaaatgatcttcataagaaatcaagccggattgtttcagcaaagtcacaggctgagatcctattttttctgcagaatcaatcattttttacggaagaagaggaagcggtgctgaaaagaggcagaaatgccaagtcagggacaacacctaaaaatacagatgttcagacgtaccgctacagtacagcatttgaagcgcttctgggctacctttttctagagaaaaaagaggaacgacttagtcagctcgtagccgaagctatacaattcgggacgtcagggaggaaaacaaatgagtcagcaacatgattacgtcatagggaaaaatgcagtgatcgagacgttaaaatctgatcggaagctgtataagctgtggatggcggaaaacaccgtaaagggacaagcacagcaagtgattgagcttgccaaaaagcagggaatcacgattcaatacgtcccgagaaaaaaactcgatcaaatggtgacaggacagcatcagggcgtagtggcacaggttgcagcgtatgaatatgcagaactggacgatttatataaagcagccgaagaaaaaaatgaacagcctttcttcctcattctggacgagcttgaagaccctcataaccttggttccattatgaggacagcagatgcggtcggcgctcatggcatcgtcattccaaaacggagagctgtcgggctgacaacaacagtggcaaaagcttcaacaggagcaattgagcacattcctgtagcaagagtcaccaatttggcacggacgttagaagagatgaaagagcggggaatctgggttgtcggaacggatgcgtccgcgcgtgaggattaccgtaatatggacggcaatatgcctttggctctagtcatcggaagtgaaggaaaagggatgggccgccttgtgaaggaaaagtgcgattttctcattaaactcccgatggccggaaaggtaacttcactaaatgcatctgtcgcggctggtcttttgatgtatgaagtctaccggaaacgaaaccctgtgggagaataaagacccatggatatcctgttagtagacgggtacaacatgattggagcctggccgcagctgaaggatttaaaagcgaacagttttgaagaggcgagagacgtactgattcagaaaatggcggaatatcaatcgtatacaggaaacagggttattgttgtttttgacgcgcatctcgtaaaagggcttgagaaaaaacagaccaaccatagagttgaagtaatttttacaaaagaaaatgagacggctgatgagcggatagaaaagctcgctcaggctttgaataatattgcgactcaaattcacgttgcgacctctgactatactgagcagtgggcgattttcggacagggggcattgcggaaatcggcccgggagcttttgagagaggtagaaacgattgaaaggcgaatagagagacgggtaagaaaaatcacttccgaaaagccggcgggtaaaattgctttatcggaagaggttttgaaaacgtttgaaaagtggaggcggggagacttagattaagttgacgcttttttgcccaatactgtataatatttctatctacgtgcgccggggggatcggagtgaatctacagaacaacaagggaaaattcaacaaagagcagttttgccagttggaggacgagcaggtcattgaaaaggttcatgttggggacagtgatgcgttagattacttgattacgaagtaccgaaactttgttcgggcaaaagcaagatcctatttcttaataggggcggacagagaggatattgttcaggaaggcatgataggcctctataagtctattcgtgacttcaaagaggacaagcttacctcattcaaagctttcgcagaattatgtattacccgccaaattattaccgcaataaagacagctactcgccagaaacacattcctttgaattcctacgtctcattagataaaccgatttttgatgaagaatcagaccgaacgctgctggatgtcatttcaggagcgaaaaccttaaatcctgaggaaatgatcattaatcaggaagaatttgatgatattgaaatgaaaatgggagaactattaagtgatttagagagaaaagtactcgtcttatatctcgacgggagaagttaccaagagatttctgatgaactgaaccgacatgtgaaatcgatcgacaatgcccttcagcgtgtgaaacgcaagctggagaagtacttggaaattcgcgaaatcagtttgtaataggaatttatgctatattgacagtatttttctgactatgatatgttactaaagataagaactaatgtctatttagaaaaaggtgtaatgacatgagaaaaaagattacgttagcatgcaagacatgcggaaaccgtaattatacgacaatgaagagctctgcatcagcggctgagcgattagaagtaaagaaatactgcagtacttgcaattcacatacagctcatcttgaaacaaaatagtttttgcgcttttaaattgtggaggtcttttacatgcgtattatgaaattctttaaagatgttgggaaagaaatgaaaaaggtaagctggcctaaaggaaaagagttaacgcgttataccattacggtaatttcaacagttatcttttttgttatcttttttgccctccttgacacaggaatttctcaattaattcgtttaatagttgaataatgatcagcaatacgtgctataatagatcataatattacttgccaaaacccgttcagcgggttttttattgtggcttaaaatgatagttatcataggcttgccgcctattttttgaagcgttatggtaattcactaaaaccaaatgcggggagggaaggactggacagtcctgaatagaatggaaaagaattggtatgttgttcacacgtactctggttatgagaataaagtaaaagccaacttggaaaaacgtgttgaatcaatggggatgcaggataaaattttccgtgtagtcgtacccgaagaagaagaaacggatatcaaaaacggcaagaaaaaagtcgtgaaaaagaaagtgttccctggttatgtgcttgttgaaattgtaatgacagacgactcttggtatgttgtccgaaacacgccgggcgttactggattcgtaggatctgccgggtcaggttcaaaaccgacgccgcttcttccgggcgaagcagaaaccattctgaagagaatgggcatggatgaacgcaaaactgatattgactttgaactgaaagagacagtgaaagtaatagacggaccttttgctaactttacaggatcaattgaagagattgattatgataaaagcaaggtcaaagttttcgttaatatgttcggccgtgaaacgccggttgagctggaatttacccaaatcgataaattgtaatgtgaaaaaacttgaaattgctatatataaatgataatatagcaaaggtacgtcttggacttatccaaggcaactagcatgatatttcgtcattcatataaagaatgaaaccttgagtgggagggtttaccctattaccacatcacggacttaaggaggtgtgtctcgtggctaaaaaagtagttaaagttgtaaaattgcaaattcctgctggaaaagctaacccagcaccaccagttggacctgcacttggtcaagccggtgttaacatcatgggattctgtaaggagtttaacgctcgtacagctgaccaagctggtttaatcattcctgttgaaatttcggtttacgaagaccgttcatttacatttattacaaaaactccacctgctgcagtattgcttaaaaaagcagctggaattgagtctggttctggtgaaccaaaccgtaataaagtggcaaccgttaagcgcgataaagtacgcgaaatcgctgaaacgaaaatgcctgacttaaacgcagcagacgttgaagcggcaatgcgcatggttgaaggtactgcccgcagtatgggtattgtaatcgaggattaatttgtttcttgtcgggttgcgagttttaacaagttcgcaacccttattcgtgggaggttattccgctataaccacataaggaggaaattttaaaatggctaaaaaaggtaaaaagtacgttgaagctgctaagcttgtagaccgttctaaagcttacgacgtctctgaagcagtagctctcgttaaaaaaacaaacacagctaaattcgacgctacagttgaagtggctttccgtttaggggttgaccctcgtaaaaacgaccagcaaatccgtggagcagttgtgcttccaaacggaactggtaaaactcagcgcgttctcgttttcgcaaaaggcgaaaaagcgaaagaagctgaagctgctggtgcagatttcgtaggcgacactgactacatcaacaaaattcaacaaggctggttcgatttcgatgttatcgtagctacacctgacatgatgggtgaagttggtaaaatcggtcgtgtacttggaccaaaaggtttaatgccaaaccctaaaactggtacagttactttcgaagttgaaaaagcgatcggcgaaatcaaagctggtaaagttgaataccgcgttgataaagctggaaacattcatgttcctatcggtaaagtttctttcgaggatgaaaaacttgttgagaacttcacaacaatgtacgatacaatccttaaagctaaacctgctgcagctaaaggcgtttacgtgaaaaacgttgctgtaacttctactatgggacctggtgtcaaagtagactcttcaacttttaacgtaaaataatattgacacgacatcaacattctgatattattcaaaatgttgtaaaatagaatatcatttataccgtagacagtaggggcctaaccgcttaattatcctaccgaggtgtatattatcacagctattacgttacgtatgcttgtatatacagcctccatgtctcatggaggctttttatatggaatccgtcgtctcagtcgtgatcacctaacggtataagtgttacacaagaatctacaggaggtgtaaccatgagcagcgcaattgaaacaaaaaaagttgttgttgaagaaattgcttctaaactgaaagaaagtaaatcaacgatcatcgttgactatcgcggacttaacgtttctgaagtaactgaacttcgtaaacagcttcgcgaagctaacgttgagttcaaagtttacaaaaatacgatgactcgccgtgcggttgaacaagctgagcttaatggtttgaatgatttcttaactggaccgaacgcgatcgcattcagcactgaagatgttgtcgctccggctaaagttcttaatgacttcgctaaaaatcacgaagctcttgaaatcaaagctggcgttatcgaaggtaaagtttctactgttgaagaagtgaaagctcttgctgaacttccatcacgcgaaggcttgctttctatgttgcttagcgtacttcaagctccagttcgcaaccttgctcttgctgcaaaagctgtggcagaacaaaaggaagaacaaggcgcttaatctaatcagtttttcataaattaaaacaaaatggaggaattacaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgcaggcggagctgctgaagagcaaagcgaattcgatcttatccttgctggtgcaggatctcaaaaaatcaaagttatcaaagttgtacgtgaaatcactggtcttggcctgaaagaagctaaagaacttgttgacaacactccaaaaccacttaaagaaggtattgctaaagaagaagctgaagagcttaaagctaaacttgaagaagttggcgcttctgtagaagttaagtaatcttcacttacctgtagggaagctcgcttttatgaggcgagctttttctttgccgttctttaagccatgaaaaaaaggaggttctaataatgagtgagcactattattcagaaaaaccttcagtgaaaagcaacaagcaaacctggtcttttaggcttcggaataaagatttcacgtttaccagcgatagcggggttttttctaaaaaagaagttgatttcggctcccgtctgctgattgattcttttgaagagcctgaggttgagggcggcattttggatgtaggctgcggatacggcccgattggtttatcgctcgccagcgactttaaagaccggactatccacatgattgacgttaatgagagagccgtagaactatcaaatgaaaatgcggaacaaaacggaataacaaacgttaagatttatcaaagcgatttgttttcaaacgttgattctgctcaaacatttgcttctattcttacaaatcccccaatccgagccggaaaaaaagttgtccatgctatctttgagaaaagcgctgaacacttaaaagcttcaggtgaattgtggatcgtcatacagaaaaagcagggcgcgccttctgccattgaaaagctcgaggaactgttcgatgaggtttctgtcgttcaaaaaaagaaaggctattatatcataaaagcaaaaaaagtttgactcggtattttaactatgttaatattgtaaaatgccaatgtatatattttgcttgatatgatgaattgtcaatatctatgtataaattatacaagtatggaaatgctaataaaatcggtatttgtttttggatgtggttttcttaattagaaacccttttttcttttgtcttgtaaaagtattttctttctttggaagaaatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctcttgagttcattgattatagtttaggtgagcctaaatatcctgtagaggaatcaaaagaacgtgatgtgacttactcagctccgctaagagtgaaggttcgtttaattaacaaagaaactggagaggtaaaagaccaagatgtcttcatgggtgatttccctattatgacagatacaggtacttttatcattaacggtgcggaacgcgttatcgtttcccagcttgttcggtctccaagtgtatatttcagtggtaaagtagacaaaaacggtaaaaaaggttttaccgcaactgtcattccaaaccgtggcgcatggttagaatacgaaactgatgcgaaagatgttgtttatgtccgcattgatcgcacacgtaagttgccggttacggttcttttgcgtgctctcggcttcggctccgatcaagagattcttgatctcataggagaaaacgaatacctgcgaaatacgcttgataaagataacacagaaaacagcgacaaagcgttgctggaaatttacgagcgtctccgtcctggagagccgcctacagtagaaaatgcgaaaagcttgcttgattctcgtttctttgatccgaaacgatacgatcttgccaatgtaggacgctataaaattaataaaaaacttcatattaagaatcgcctcttcaatcagagacttgctgaaacgcttgttgatcctgaaacaggagaaatccttgctgaaaaaggccagattcttgatagaagaacacttgataaagtactgccatacttagaaaacggaatcggtttcagaaagctgtatccgaatggcggcgttgttgaagatgaagtgactcttcaatcaattaaaatctttgctccgactgatcaagaaggagaacaggttattaatgtaatcggcaatgcttacatcgaagaagagattaaaaacatcacgcctgctgatattatttcttcaatcagctacttcttcaacctgctgcacggagtaggcgacacagatgatatcgatcatcttggaaaccgccgtttacgttctgtaggcgagcttctccagaaccaattccgtatcggtttaagccgtatggagcgtgtggttcgtgagagaatgtcaattcaagatacgaatacaattacgcctcagcaactgatcaatattcgtcctgttattgcgtccattaaagagttctttggaagctcacagctttctcaattcatggatcagacgaacccgcttgctgaattaacgcacaagcgtcgtctgtctgcattaggaccgggcggattgacacgtgagcgtgccggaatggaagtgcgtgacgttcactactcccactatggccgtatgtgtccgattgaaacgcctgagggcccgaacatcggtttgatcaactcactatcatcttatgcaaaagtaaaccgttttggctttattgaaacgccatatcgccgcgttgaccctgaaacagggaaggtaacgggcagaatcgattacttaactgctgatgaagaggataactatgttgtcgctcaagcgaatgctcgtcttgatgacgaaggcgcctttattgatgacagcatcgtagctcgtttccgcggggagaacaccgttgtttccagaaatcgtgtagactacatggatgtatcacctaagcaggttgtatctgctgcgacagcatgtatcccgttcttagaaaacgatgactccaaccgtgccctcatgggagcgaacatgcagcgtcaggctgtgcctttgatgcagccggaagcgccatttgttggaactggtatggaatacgtatcaggaaaagactctggtgccgctgttatttgtaaacaccctggtatcgttgaacgcgtagaagcgaaaaacgtttgggttcgccgttatgaagaagtagacggtcaaaaagtaaaaggaaacctggataaatacagcctgctgaaatttgtccgctctaaccaaggtacgtgctacaaccagcgtccgatcgtaagtgtcggcgatgaagtggtaaaaggagaaatccttgctgacggtccttctatggagcttggtgaacttgcacttggccgtaacgtaatggtcggcttcatgacatgggatggctacaactatgaggatgccatcatcatgagtgaacgcctagtgaaggatgatgtttatacatctatccacattgaagaatacgaatcagaagcacgtgatacgaaacttggacctgaagaaatcactcgcgatattccaaacgtcggtgaagatgcgcttcgcaatcttgatgaccgcggaatcatccgtattggggcagaagtaaaagacggagatcttcttgttggtaaagtaacgcctaaaggcgtaactgaactgaccgcagaagaacgccttcttcacgccatctttggcgagaaagcccgcgaggttcgtgatacttctcttcgtgtgcctcatggcggcggcggaattatccatgacgttaaagtcttcaaccgtgaagacggagacgaacttcctccaggtgttaaccagttagtacgcgtatatatcgttcagaaacgtaagatttctgaaggagataaaatggccggtcgtcacggtaacaaaggtgttatctctaagattcttcctgaagaggatatgccttaccttcctgacggcacaccaattgatatcatgcttaacccgctgggcgtaccatcacgtatgaacatcgggcaggtattagaacttcacatgggtatggccgctcgttaccttggcattcacattgcatctcctgtatttgacggagcgcgagaagaggatgtctgggaaacacttgaagaagccggcatgtctcgtgacgccaaaacagtgctttacgacggacgtactggagagccgtttgataaccgtgtatctgtcggtatcatgtacatgatcaaactagctcacatggttgacgataaacttcatgcacgctctacaggtccttactcacttgttacgcagcagcctcttggcggtaaagcgcaatttggcggacagcgttttggtgagatggaggtttgggcacttgaagcttacggtgcggcttacactcttcaagaaattctgactgttaagtctgatgacgtggttggacgtgtgaaaacatacgaagccatcgttaaaggcgacaatgttcctgaaccaggtgttccggaatcattcaaagtattaatcaaagaacttcaaagcttaggtatggatgtcaaaatcctttctggtgatgaagaagaaatagaaatgagagatttagaagacgaagaagatgcgaaacaagctgacggcctggcattatcaggtgatgaagagccggaagaaacagcatctgcagacgttgaacgcgatgtagtaacaaaagaataatctctagttataaaggcaagtgacatcggttaatccgaagataaaaagggaggtaggccccttgctagatgtgaacaattttgagtatatgaacatcggtcttgcttcaccagataaaatccgttcatggtcttttggtgaagtgaaaaagcctgaaacgataaactatcgtacgttaaaacctgaaaaggacggtctattctgcgaacgcattttcggacctactaaggactgggaatgtcattgcgggaagtacaagcgagttcgttataaaggcgtagtttgtgaccgctgcggagtcgaagtaacacgggctaaagtccgtcgtgagagaatggggcacattgaactggctgccccagtttcccacatttggtatttcaaaggtattccaagccgtatgggccttgtgctggatatgtcacctcgtgctttagaagaagtcatttactttgcttcttacgttgtaactgatccggcgaatacaccgcttgaaaagaaacagcttctgtctgagaaagaataccgtgcttatcttgataaatacggtaataaattccaagcatctatgggtgctgaagcaattcataaacttcttcaagatatcgatcttgtaaaagaagttgatatgttaaaagaagagctaaaaacttcacaaggacaacgccgtactcgtgcgatcaaacgtcttgaagttttagaagccttccgtaactcaggaaacaagccttcttggatgattcttgatgtgcttcctgttattcctccggagcttagaccgatggttcagctagatggcggacgttttgcgacttctgatttgaatgacctttatcgtcgtgtcatcaaccgtaacaatcgtttgaaacgccttttggaccttggtgcgcctagcatcatcgttcaaaacgaaaagcgtatgcttcaagaggctgtcgatgccctaattgacaacggccgccgcggacgccctgtaacaggtcctggtaacagaccgttaaaatctctttctcacatgctgaaagggaagcaaggccgtttccgtcaaaaccttcttggtaaacgtgtcgattactccggacgttctgtaatcgttgttggtcctcatttgaaaatgtaccaatgcggattaccgaaggaaatggcgcttgaacttttcaaacctttcgttatgaaagaacttgttgaaaaaggtcttgctcacaacattaagagtgcgaaacgcaaaattgagcgcgtacagcctgaagtttgggatgtactagaatcagttattaaggagcacccggtactgctgaaccgtgcccctacacttcacagattaggtatccaggcgtttgaaccaacgcttgttgaaggacgcgcaatccgtcttcacccgctcgtatgtacagcttacaacgctgactttgacggtgaccaaatggcggttcacgtaccattatctgctgaagcacaagctgaagcacgcatcttgatgcttgctgctcaaaacatcttgaaccctaaagatggtaaaccagttgtaacaccgtctcaggatatggtactgggtaactattacctgacacttgagcgtgccggtgctgtcggtgaaggcatggtcttcaagaatacagacgaagcgcttcttgcttatcaaaacggatatgttcaccttcatacgagagtagctgttgcagctaactcacttaagaatgtgacatttaccgaagaacagcgctcaaaattgttaattacaactgtcggtaagcttgtcttcaatgaaattcttccggaatcattcccttacatgaatgaaccaacgaagagcaacattgaagagaaaacacctgaccgtttcttcttagaaaaaggtgctgacgttaaagctgttatcgcacagcagccaatcaatgcgccgtttaaaaaaggcattctgggaaaaatcatcgcggaaatctttaaacgattccatattacggaaacgtctaaaatgcttgaccgcatgaaaaacctaggtttcaaatattcaacaaaagctggtattacagttggggtttctgacatcgtcgtactcgatgataaacaagaaattcttgaagaagcgcaaagcaaagttgacaacgttatgaagcagttccgccgcggtcttatcactgaagaagaacgctatgagagagtcatctctatctggagtgctgcaaaagacgttatccaaggcaaactgatgaaatcacttgatgaactcaacccgatctacatgatgagtgactctggtgcccgtggtaacgcatctaactttacgcagcttgccggaatgcgcggcctgatggccaacccggctggacgtatcattgagttgccgatcaaatcaagtttccgtgaaggtctgacagtattggagtactttatctccacacacggtgcgcgtaaaggtcttgccgataccgctcttaaaactgctgactcaggttaccttacacgccgtctcgttgacgttgcgcaggatgttatcattcgtgaaactgattgcggaactgaccgaggcattcttgctaagcctcttaaagaaggaactgaaacaattgagcgcttagaagaacgcttaatcggacgttttgcaagaaaacaagtgaagcaccctgaaacaggtgaagtgcttgtgaatgaaaacgaactgatcgatgaagataaagcactggagattgtcgaagccggcattgaagaagtgtggatccgttctgccttcacatgtaatacgcctcatggtgtatgtaaacgatgctatggccgaaatcttgcaactggctccgatgttgaagtcggtgaagctgtcggaatcattgctgcccaatcaatcggtgagcctggtacacagttaacaatgcgtacattccatacaggcggggttgccggagacgatattacacagggtcttccgcgtatccaagagcttttcgaagcgcgtaatccgaaaggtcaggcaacaattacagaaatcgacggtactgtcgttgagatcaatgaagttcgtgataagcaacaggaaattgtggttcaaggcgcagtggaaacacgttcttatacggcaccttacaactcccgcctgaaagtagcggaaggagataaaattactcgaggccaagtactgacagaaggttcaatcgatccgaaagaacttcttaaagtaactgacctgacgactgttcaagagtatcttctccatgaggttcaaaaggtttaccgtatgcagggtgttgaaatcggtgataaacacgtagaagtaatggttcgccagatgcttcgcaaagtacgcgtgattgatgccggtgacactgatgtgcttccaggtacattgcttgatattcaccaatttactgaagcgaacaaaaaggtattgcttgaaggcaatcgacctgctacaggccgtcctgtcttactcggtattacaaaagcatctcttgaaactgattcattcttatctgctgcttccttccaggaaacaacacgtgtccttacagatgcagcgatcaaaggtaagcgtgacgagcttcttggcttgaaagagaatgttatcatcggtaagcttgttccagctggtacaggaatgatgaaataccgtaaagtaaaaccagtatcaaatgttcagccgactgacgatatggtcccggttgaataactgatttaatgctgctgaaagactgcaaaaacagtctttcagcagatatatttatgaaaaagtcactctatgagaagaacgaaactaaaaaatgtcataccttgttgacattcgtctcctagaatgataatataaccaaggtgctcgaaataaacctgttactttggaggatatgtttatgtcttatgataaagtatcacaggccaaatcaattattattggtacgaagcaaacagtgaaagctctaaagcgaggttcagtaaaggaagtagtcgttgcaaaagacgcagatccgatactcacgtcaagtgttgtttcacttgctgaagatcaaggtatctctgtctcaatggttgaatccatgaaaaagctcggcaaagcctgcggaattgaggtaggagcagccgctgttgccattattctataacgtacttttgtttttgcgtaagattccatcttgtgtaaagacattgttttttgccttttgatgaaccacctgggtatgtgggttataaaacgcaatgaagggaggaaaaattcatgcctacaattaatcagctaattcgcaaaggacgcgtgagtaaagtagaaaactcaaagtctcctgcacttaacaaaggatacaacagctttaaaaaagagcacactaacgtatcttctccacaaaaacgcggggtatgtactcgtgttggtacaatgacaccgaaaaaaccgaactcagcacttcgtaaatatgctcgtgttcgtttgactaacggaatcgaggttactgcttacattcctggtatcggtcacaacctgcaagagcacagtgttgtacttatccgcggcggacgtgtaaaagacttaccaggggtacgttaccacatcgttcgtggtgcgcttgatactgctggagttgaaaaccgtgcacaaggccgttctaaatacggtacgaaaaaacctaaagcaaaataatatacgaaaatacgcataattgatgaagggaggatattcagatgccacgtaaaggtcctgtagcaaaaagagatgttttacctgatccgatttacaactctaagcttgtatctcgtctaatcaacaaaatgatgatcgatggtaaaaaaggtaagtctcaaacaatcctatacaagtcattcgatatcattaaagaacgtactggcaatgatgcaatggaggttttcgaacaagcattgaaaaacatcatgcctgtacttgaagtaaaagcacgccgtgtaggtggtgcgaactaccaagttcctgtagaagttcgtcctgaacgtcgtacgactcttggacttcgctggttagttaactacgctcgtcttcgcggagaaaaaacgatggaagagcgtttagctaacgaaatccttgacgcagctaacaacactggtgctgctgttaagaaacgtgaagacactcataagatggctgaagcaaacaaagcatttgctcactatcgctggtaggatttatagattaacaaaacacaatttcctaataaggaaggagaaattacccaatggcaagagagttctccttagaaaaaactcgtaatatcggtatcatggctcacatcgatgccggtaaaacgacaactacagaacgtatcttgttctatactggtcgtatccacaaaattggtgaaactcatgaaggagcttcacaaatggactggatggagcaggaacaagaacgtggtatcacaatcacttccgctgcgacaactgcacagtggaaaggataccgcgtaaacatcatcgatactccaggacacgtagacttcacagttgaagttgaacgttctcttcgtgtacttgatggtgctgttgctgtacttgacgcgcaatcaggcgttgagcctcaaacagaaactgtttggcgtcaggcaacaacttatggagtaccgcgtatcgtttttgttaacaaaatggacaaaatcggtgcagacttcctttactctgtaggaactttaagagaccgtcttcaagcaaacgctcatgcaattcaattgccgatcggtgctgaagataacttcgaaggtatcattgaccttgtagaaaacgttgcgtatttctacgaagatgacctcggaactcgttctgatgcaaaagaaatccctgaagagtacaaagagcaagctgaagagcttcgcaacagccttattgaagctgtatgtgagcttgatgaagagcttatggataagtaccttgagggtgaagaaatcacaattgacgagttaaaagcaggaattcgtaaaggtacattaaatgttgaattctaccctgttcttgttggttctgctttcaaaaacaaaggtgttcaactagtacttgatgctgttcttgactaccttcctgcaccaactgacgttgctgcaatcaaaggtacacgtcctgatacaaatgaagagattgagcgtcattcttctgacgaagagccattctctgcattagcatttaaagttatgactgacccttacgttggtaagttgacgttcttccgtgtgtactctggaacacttgattctggttcatacgtgaaaaactctactaaaggcaaacgtgagcgtgttggacgtattcttcaaatgcacgctaacagccgtgaagaaatctctactgtatacgcaggggatatcgcagctgctgtaggtctaaaagatacaactactggagatactctatgtgatgagaaggatcttgttatccttgagtcaatggaattcccagaaccagttatcgacgttgctattgagcctaaatcaaaagctgaccaagataaaatgggtatcgctttagcgaaacttgctgaagaagatcctacattccgtactcaaacaaacccagaaactggccaaacgatcatctctggtatgggtgaacttcaccttgatatcattgttgaccgtatgaaacgcgaatttaaagtagaagccaatgttggtgctcctcaagttgcgtaccgtgaaacattccgtaccggtgcaaaagttgaaggtaaattcgtacgtcagtctggtggacgcggtcagttcggacacgtttggatcgaattcgaaccaaacgaagaaggcgctggctttgaatttgaaaatgcgattgtcggtggggtcgttcctcgtgaatatatcccagctgttcaagcaggtctggaagaggcacttgaaaatggtgtactagcaggcttcccgcttatcgacattaaagctaaacttttcgacggttcttaccatgatgttgactcaaacgaaatggcatttaaagttgctgcttctatggcattgaaaaatgcagtcagcaaatgtaacccagttcttcttgaaccaatcatgaaagtggaagtggttattccagaagaatacatgggagatatcatgggtgatatcacttcacgtcgcggacgcgtagaaggtatggaagcacgcggtaacgctcaagttgttcgcgctatggttcctcttgctgaaatgttcggttacgctactgcacttcgttctaatacgcaaggtcgcggtacgttcactatgcacatggatcactacgaagaagtgccgaagagcgtcgcagaagaaattatcaaaaaaaataaaggcgaataattgattttgccgcttaactcaagtataactactattgtaagatgaggaagtgaaagctttctttcacttcctatcactctatacattactaattaaaagctcttaaggaggattttagaatggctaaagaaaaattcgaccgttccaaatcacatgccaatattggtacaattggacacgttgaccatggtaaaacaactttaactgctgctatcacaacagtacttcataagaaatctggtaaaggtacagctatggcgtacgatcaaattgatggtgctccagaagaacgtgagcgcggtatcacaatctctactgcacacgttgagtacgaaactgaaactcgtcactatgcacacgttgactgcccaggacacgctgactatgttaaaaacatgatcactggtgctgctcaaatggacggagctatccttgtagtatctgctgctgatggcccaatgccacaaactcgtgagcacatccttctttctaaaaacgttggtgtaccatacatcgttgtatttttaaacaaatgcgacatggtagacgacgaagagcttcttgaactagttgaaatggaagttcgcgatcttcttagcgaatacgacttccctggtgatgatgtaccagttgttaaaggttctgctcttaaagctcttgaaggagacgctgagtgggaagctaaaatcttcgaacttatggatgcggttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagagaacaagaaaacaactgttacaggtgttgaaatgttccgtaagcttcttgattacgctgaagctggtgacaacattggtgcccttcttcgcggtgtatctcgtgaagaaatccaacgtggtcaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatccatcttccagaaggcgtagaaatggttatgcctggagataacactgaaatgaacgttgaacttatttctacaatcgctatcgaagaaggaactcgtttctctattcgtgaaggcggacgtactgttggttcaggcgttgtttctacaatcactgagtaatagtatgattttaaacgagacccctgtgggtctcgttttttgtttgcttatctttttcttgtataataggatctatcatattcgaggggttaatatttatgattcctgaaaagaaatcaatcgcaatcatgaaagaactaagcattggaaatacaaagcaaatgctgatgattaatggagttgacgtgaaaaatccattgctgctttttttacatggcgggccgggaacgccgcaaatcggatatgttagacattatcaaaaagagctggaacagtattttacagtagttcattgggatcagagaggatcggggctttcttattctaagcgaatttcgcatcactctatgacaataaatcacttcattaaagatacaatccaagtcactcaatggcttttagctcatttttcaaaatcaaaactttacctagccggtcattcttggggatcaatactggcgcttcatgtgctgcagcagcgtcctgatttattttacacgtattatggaatcagccaggttgttaacccgcaagatgaagaatcaactgcttatcaacatattcgtgaaatttccgaatcaaaaaaagccagcatattatctttccttacacgtttcattggtgctccgccttggaagcaggatatccagcaccttatctatcggttttgtgttgagctaaccaggggaggattcactcaccgtcatcgtcaatctctagctgtattatttcaaatgcttactggcaatgagtatggagtgcggaacatgcacagcttccttaatggattgcgcttcagtaaaaaacatttaactgatgagttgtaccggtttaatgcttttacatcagttccttctattaaagtaccgtgtgttttcatttcagggaaacatgacttaattgttcctgctgaaatatcgaaacagtattatcaagagcttgaggcacccgaaaagcgctggtttcaatttgagaactcagctcacaccccgcatattgaggagccggcattattcgcgaacacattaagtcgacatgcacgacaccatttatgatagatccttgataaataagaaaaacccctgtataataaaaaaagtgtgcaaaccatgcatattttaaataagtcttgcaacatgcgcctattttctgtataatggtgtatgttggtctttgactgcgatgaagtgagaggttgctgacacacccggccgctttgccatggcaaggtgttcaggtttttctcacggagaactgtctaacgtgatgtaggcgaaaaggagggaaaataatggcaaaacaaaaaattcgtattcgtttgaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctcttatgcgattagacttaccatctggtgtcgatatcgaaattaaactttaattctaaaatatagaatgatcttaataggaggtgtgacgaatgaccaaaggaatcttaggaagaaaaattggtatgacgcaagtattcgctgagaatggtgatcttattccggtaactgttatcgaggctgctccaaacgttgttcttcaaaagaaaacagctgaaaacgacggttacgaagcaatccagcttggttttgacgacaagcgtgaaaagctttctaacaaacctgaaaaagggcacgttgcaaaagcggaaactgctcctaagcgcttcgttaaagaattacgcggagtggaaatggatgcgtatgaagttggtcaggaagtcaaggttgaaattttctctgctggagaaatcgtagatgtaacaggagtatctaaaggtaaaggtttccaaggtgcgatcaagcgccacggacaatctcgcggacctatgtctcacggttcacgctaccaccgtcgtcctggttcaatgggacctgtagatcctaaccgtgtattcaaaggtaaattattacctggacgtatgggcggagagcaaatcactgttcaaaaccttgaaatcgtaaaagttgatgcagaacgcaatcttcttttgatcaaaggtaacgtacctggtgcgaagaaatctttaatcactgttaaaagtgctgttaaatctaaataattctcttaggaaaggaggaaattgattatgccaaaagtagcattatacaaccaaaacggttctactgctggtgacatcgaattaaatgcttctgtatttggtatcgaaccaaatgagagtgttgtattcgacgctattcttatgcaaagagcttccttacgtcaaggaactcacaaagtaaaaaatcgttctgaagtacgcggcggaggtcgtaaaccatggcgtcaaaaaggtactggacgtgcccgtcaaggttcaatccgttcaccgcaatggcgcggaggtggtgtcgtattcggcccaacaccacgcagctattcttataaattacctaaaaaagttcgccgcttggcaatcaaatcagtattgtcttctaaagtgatcgacaacaacatcatcgttcttgaagatcttactcttgatacggctaaaacaaaagaaatggcagctatccttaaaggattatctgttgagaaaaaagctttaatcgtaactgcggatgcaaacgaagcagtagcattatctgctcgtaacattcctggagttactgttgttgaagctaatggaatcaacgttttagacgttgtcaaccacgagaagcttctgattacaaaagcagcggttgaaaaagtagaggaggtgcttgcataatgaaagatcctcgtgatgttctaaagcgccccgtcattactgaacgttctgctgatttaatgactgaaaaaaaatatacttttgaagttgatgtaagagctaacaaaacagaagtgaaagacgcggttgaaagcatctttggagtgaaagttgacaaagtcaacatcatgaactacaaaggcaaatcaaaacgtgttggacgctacactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaatggacgtcgtggcatgacaacttcagattttgctgaaatcacgactgacaagccggaaaaatccttgcttgctccccttcacaaaaaaggtggacgtaacaaccaaggtaaattgactgtacgtcaccaaggtggcggacataaacgccaataccgtgttatcgacttcaaacgcgataaagatggtatacctggacgcgttgctacagttgaatacgatccaaaccgttcagctaacatcgctctaatcaactatgcagacggagaaaaacgttacattcttgctcctaaaggaattcaagtaggtactgaaatcatgtcaggtcctgaagctgacattaaagtaggtaatgcacttccacttatcaacatccctgttggtacagttgtgcataacattgaattaaaacctggtaaaggcggacagcttgtacgttcagctggtacatctgctcaggttcttggtaaagaaggtaaatacgttcttgtacgtcttaactctggtgaagttcgcatgatcctttctgcttgccgtgcttctatcggtcaagtaggtaacgaacagcacgaacttatcaacattggtaaagctggacgttctcgctggaaaggcatccgtcctacagttcgtggttctgtaatgaaccctaacgatcacccacacggtggtggtgaaggacgtgcgccaatcggacgtaaatcaccaatgtctccatggggcaaaccaactcttggattcaagactcgtaagaaaaagaacaaatccgataaatttatcgtacgtcgtcgtaaaaataaataacggggttgtctacggttcttttcggaccgtagtgcaatcacgaagggaggttccaaaatggctcgcagcttaaaaaaaggaccatttgtcgatggacacttgatgactaaaatcgagaaattaaatgaaacagacaagaaacaagtcgtaaaaacttggtctcgtcgttctactattttcccacagtttattggtcacacaatcgcagtctatgacggacgtaaacacgtgcctgtattcatctctgaagatatggtagggcacaagttgggtgaattcgctccaactcgtacgtacaaaggtcatgctagtgatgacaaaaaaacaagacgctaagagaggaggcttttaaatgcaagctaaagctgttgcaagaacagtccgtattgctcctcgtaaagcacgtctagtaatggacctgattcgaggcaagcaagtaggtgaggcagtatcaatcttgaaccttacaccaagagctgcttctccaattatcgagaaagtattaaaatccgctattgcaaatgctgagcataactatgaaatggacgctaacaacctggttatttctcaagcattcgttgacgaaggccctacgttaaaaagattccgcccacgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaatacattagcaaacgcctttctgacgcttctgtttctaaagtagaaatcgagcgtgcagcaaaccgcgttaacattacgatccacacagctaagcctggtatggttatcggtaaaggcggttctgaagtcgaagcacttcgcaaagcccttaacagccttactggcaagcgtgtacacattaacattcttgaaatcaaaagagcagatcttgatgcacagctagttgctgacaacatcgctcgtcaattagaaaaccgtgtttctttccgccgtgcgcagaaacaacaaatccaacgtactatgcgtgctggagcacaaggtgtgaaaacaatggtttctggtcgtcttggcggtgcagatatcgctcgttctgaatactacagtgaaggaactgttccattgcacacattacgtgcggacattgactatgcaacatctgaagctgatactacttacggtaagcttggtgtaaaagtctggatctatcgtggagaggttcttcctactaagaagaaaaaagaggaaggaggaaaataatatgttattaccaaaacgcgttaaatatcgcagagagcatcgcggaaaaatgcgtggccgtgcgaaaggcggtactgaagtacattttggagaattcggtatccaagctcttgaagcttcttggattactaaccgtcaaatcgaagctgcacgtattgcgatgactcgttacatgaaacgtggcggtaaagtttggatcaaaattttcccttctaaaccttacactgctaaaccacttgaggtacgtatgggatccggtaaaggggctccagaaggttgggtagctgttgtaaaaccgggcaaagttttatttgaaatttctggtgtgtctgaagaggttgctcgtgaagcgcttcgccttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgctaataaataatcactgaggggaggtcgtgagcatgagcgaacgtaaccaacgcaaagtttaccaaggccgtgttgtttctgacaaaatggataaaaccattactgttgttgttgagacatacaaaaaacatacactttacggtaaacgcgtaaaatactcaaaaaaattcaaagcacatgatgaaaataatcaagctaaaatcggtgacatcgttaagatcatggaaactcgtccattgtctgcaactaagcgtttccgtctagttgaagttgtcgaagaagctgttattatctaataaagttcggaattctttttccgaagggaggtaacaaataatgattcaacaagagactcgtttaaaagtagctgacaactctggcgcacgtgaagtacttactattaaagttcttggtggttctggacgtaaaacagctaacattggtgatgtaattgtttgcacggttaaacaagcaacaccaggaggcgttgtcaaaaaaggtgaagtcgtaaaagctgttatcgttcgcactaaaagcggagcgcgcagaagtgacggttcatacatcagcttcgatgagaatgcatgtgttatcatccgtgacgacaagagcccacgcggaactcgtatcttcggaccagttgctcgtgaattgcgtgaaaacaactttatgaaaattgtttctctagctccagaagttatctaatgaaataaatgccttactcaaggaggtgcgatcaggatgcatgtaaaaaaaggcgataaagttatggttatctctggtaaagataaaggcaaacaaggaacaatccttgctgctttccctaaaaaggaccgcgttttagttgaaggtgttaacatggtaaagaaacactctaaaccaactcaagctaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgtagcaaaaaaatctgggcaagttctagataaatagtattaaaaggaagggaggtctatctcatgaaccgccttaaagaaaagtacaataaagaaattgcacctgctttaatgactaagttcaactatgattcagtcatgcaagtgcctaaaattgaaaaaatcgtaatcaacatgggtgttggtgacgctgttcaaaacgccaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcggggtttctaaaaaatctttcgacggtcgcggtaactacacacttggtatcaaagaacagttaatcttccctgaaattgactacgataaagtaacaaaggttcgcggaatggacatcgttatcgtaacaactgctaatactgacgaagaagctcgtgagctattaactcaagtaggtatgccgttccagaaataatcaatgaaagggaggcgaaatcgtggctaaaaagtctatgattgcgaaacaacaacgtacaccaaagtttaaagtacaagagtacacacgctgtgaacgctgcggacgtccgcattcagtcattcgtaaatttaaactttgccgtatttgtttccgtgagcttgcatataaaggacaaattcctggcgtgaaaaaagccagctggtaatccccaagaaagggaaggaggtaattatataatggttatgacagatccaattgcagatatgctaactcgtattcgcaatgcaaacatggtacgtcatgagaagcttgaaattcctgcttctaaattgaaaagagaaattgctgaaattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaagcctggtttgcgtgtttatgctaaatctaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacatgaatggaggtgtttggtatgtctcgtgtaggtaagaagctacttgagattccttctgatgttacagtaacgttaaatgataacaacactgtagctgtgaaaggaccaaaaggagaattaactcgtacgtttcaccctgatatggagattaaagtagaggacaatgtgcttacagtcgctcgtccttctgatcaaaaagagcaccgtgccctgcatggtacgactcgcagtctgcttggcaacatggttgaaggtgtatctaaaggatttgaaagaggtttggaattagtcggtgtcggttaccgtgcttctaaatccggaaataaacttgttttaaacgttggatactctcatcctgttgagatcgttcctgaagaaggcatcgaaatcgaagttccttctcaaacaaaagtagttgtaaaaggtacagacaaagaacgtgtaggagctattgctgctaacatccgcgctgtacgttctccagagccttacaaaggtaaaggaatccgctacgaaggtgaagttgttcgccgtaaagaaggtaaatctgctaagtaagatcgcttaaagtgaagaaaggagtgacctagatgattacgaaaactagcaaaaatgctgctcgtcttaaaagacacgctcgtgttcgcgctaaactttccggtactgctgaaagaccgcgcctgaacgttttccgttctaacaagcacatttacgctcaaatcatcgatgatgtaaatggtgtaacacttgctagtgcatctactctcgataaagacttgaacgttgaaagcactggagatacttctgctgctactaaagttggagaattagttgcaaaacgcgctgctgaaaaaggcatttctgacgtagtatttgaccgtggcggatacttataccatggacgtgtaaaagctttggctgatgccgctcgtgaagctggacttaaattttaataaaagaaggagggacacatgattatgcgtcgtattgacccaagcaaattagagttagaagaacgcttagttacggttaaccgcgtagcgaaagttgttaaaggtggtcgtcgtttccgcttcgcagctctagtcgttgtcggtgacaaaaacggacacgtaggattcggtactggtaaagcacaagaagtaccagaagcgatccgcaaagctgttgaagatgcgaaaaagaatttgattgaagtaccaatggttggaactacaattccacacgaaatcatcggacgtttcggtgcaggtaacatcttgttaaaacctgcttctgaaggtactggagttatcgctggaggccctgtacgtgcggtacttgagctagctggtgtagctgatatcctttctaagtctttaggttctaacacaccgatcaacatgattcgtgcaacacttcaaggtttaagtgaacttaaacgtgctgaagacgttgcgaagcttcgtggaaaatctgtagaagaactgttaggataaggagggaacattaatggctaaattagaaattaccctcaaacgaagtgtaatcggtcgcccggaagaccaacgcgttactgtaagaacacttggtttaaagaaaacaaaccaaactgttgttcatgaagacaacgctgcgatccgtggtatgattaataaagtatctcatttagtttctgttaaagaacaataaaaatatttgatcggataaggaggtgtcctaatgaaacttcatgaattaaaaccttcagaaggttcacgcaaaacgcgtaatcgcgtaggtcgtggtattggttctggcaacggtaaaacagctggtaaaggtcacaaaggtcaaaacgctcgttctggcggcggtgtacgccctggattcgaggggggacaaatgcctttattccaacgtcttcctaaacgcggtttcactaacatcaaccgcaaggaatacgctgtagtcaacctagacaaattgaacggttttgcagaaggaacggaagtcactcctgaacttcttctagagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaaaacaatctccaactttatgcgtgtgagtgatatcaggaataaaatcatattcactttactcatgcttatcgtctttcgcataggtgcgtttattcctgtgccttacgttaacgctgaagcgttacaggcgcagtctcaaatgggtgtttttgatctccttaatacatttggcggcggtgcgctttaccaattttccattttcgcaatgggaattactccttatatcacggcttcgatcatcattcagctgcttcagatggatgttgtaccgaagtttaccgagtggtctaagcaaggtgaagttggccgccgtaaattagctcagttcacaaggtactttacgattgtgcttggtttcatccaagcattaggtatgtcatatggatttaacaatctggcaaacggtatgctgatcgaaaaatccggtgtatcgacatatcttatcattgctttagtgctcactggcggaactgcctttttaatgtggcttggggaacaaattacttctcatggagtaggcaacggaatatcgatcattatcttcgcggggattgtgtctagtattccaaaaacaattgggcaaatatatgagactcaatttgtcggcagcaacgatcagttgtttattcatattgtgaaagtcgcacttcttgtgattgcgattttagcagttattgttggagttattttcattcagcaagccgtacggaaaattgcgattcaatatgctaaaggcacaggtcgttcacctgctggcggaggtcagtctacacaccttccattgaaagtgaatcctgcaggggttattccggtaatctttgcggttgcgtttttgataacgccgcggacgatcgcgtcattctttggaacaaacgatgtgacaaagtggattcaaaacaactttgataatacgcatccggtgggtatggcgatatatgttgcgttgattattgcctttacgtacttttatgcttttgtacaggtaaaccctgaacaaatggctgataaccttaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacaaattggcggaacatctttgttaattgttgtcggggtagccttggagacaatgaaacaactagaaagccagttggtgaaacgaaactaccgtggatttatgaaaaactagaggaaatggatttatccattccctcttaataaagagaggacgggggaaatccgaatgaacttagtcttaatggggcttcctggtgccggtaaaggcacacagggcgaacgaattgttgaggattatgggattcctcatatctcaacaggagatatgttccgtgctgctatgaaagaagaaacaccactcggactcgaagcaaaatcttatattgataagggagagctcgtacctgacgaagtcacaatcggaattgtaaaagagagacttggcaaagatgattgtgaaagaggttttcttctggacggatttccgcgaacagtcgctcaagccgaagctcttgaagaaattcttgaggaatacggcaagccgattgattatgtcattaacattgaagtcgacaaagacgctcttatggaacgtctgactggacgcagaatttgcagtgtttgcggcacaacctatcatttagtctttaatccgccgaaaacgccgggtatttgtgataatgacggaggcgaactctatcaacgggcagatgataatgaggaaacagtctctaaacggcttgaggtaaacatgaagcaaactcagcctttactcgatttctattcagagaaaggttatcttgcaaacgtgaatggccagcaggacattcaagacgtttatgcagatgtgaaggatcttcttggaggattaaaaaaatgattatctgtaaaaccccacgtgaacttggtatcatgcgggaagcagggcgaatcgtggctttaactcatgaagagttaaaaaagcacattaaaccaggaatctcgacaaaagaattggatcaaattgccgaacgttttattaagaagcagggtgcaatcccatcttttaaggggtataatgggtttcgcgggagcatttgcgtatcagttaatgaagaactcgttcacggcatacctggcagcagggtgctgaaggacggtgacatcatcagtattgatatcggtgctaaattaaatggttatcatggtgactctgcatggacatatccggtaggaaacatcagcgatgatgacaaaaaacttctggaagtgacagaggagtctttatataaaggcttgcaggaagcaaaaccaggtgaacgtttgtcgaatatttcccacgcaatacaaacgtatgtcgaaaatgagcagttttcagttgttagggagtatgtcggacatggtgttggtcaagacttgcatgaggacccgcaaattcctcattacggtccgcccaacaaaggaccacggcttaaacctggcatggttctcgctattgaacctatggtgaacgctggcagccgctacgtgaaaacattggctgataactggacggttgtaacggtagatgggaaaaagtgtgctcattttgaacatacgattgcgattacggaaacgggttttgatatactgacaagagtctagatgatgaaaataattccgaagacagatgtttttcaagcttgatagggcagaaagcttgggtgaacattggcaagaccgaattcatcttgctgcttgtcgttggaattttaaccatcatcaatgtactaacagcagacggagaaaagcgtacatttcattctcctaagaaaaagaatatcaatcatttaaccctttatgattgcgtatctccggaagttcagaacagtataaacgaaacagggcgtgtgacaaacttcttttgaaatttgtcagaaagcaagttactgatttgaagaagggagaacacttgaatggcgaaagacgatgtaattgaagtggaaggtactatagtcgaaacactgccaaacgcgatgttcaaagttgaacttgaaaatggccacactgttttggctcatgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgaaaaatgtaaagttattcgcagaaaaggaaaagtaatggtgatctgtgaaaatccaaagcataaacaaaaacaaggataatttataaggaggtgcccagagaatggctcgtattgctggtgtagatatcccacgtgacaaacgtgttgttatttctttaacatacatcttcggaattggccgcacaacggctcagcaagttttaaaagaagctggagtttcagaagatactcgtgtgcgcgatcttactgaagaagaacttggtaaaatccgtgatattattgacaaactgaaagtagaaggtgaccttcgccgtgaagtttctcttaatatcaaacgtctgatcgaaatcggaagctaccgcggaatccgtcatcgcagaggattacctgttcgcggacaaaactctaaaaacaatgcgcgtactcgtaaaggtccgcgtcgtactgtagctaacaagaaaaaataagtaagggaggttcttaaacaatggctgctgctcgtaaatctaacacgcgtaaacgtcgcgtgaaaaagaatattgagtctggaattgctcatattcgttcaactttcaataacacgatcgttacgatcactgacactcatggtaatgctatttcttggtctagtgccggagctttaggattcagaggttctcgtaaatctactccttttgctgcgcaaatggctgcagaaacagctgctaaaggttcaatcgaacatggtcttaaaactctagaggttactgttaaaggacctggttcaggccgtgaagctgcaatccgtgcacttcaagctgctggactagaagtcactgctatcagagacgtaactcctgttcctcataacggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccacttgagcgtggatatggtacaactctgggtaactccttacgtcgtatcctcttatcctcactccctggtgccgctgtaacatcaatccagatagatggtgtactgcacgaattctcgacaattgaaggcgttgtggaagatgttacaacgattatcttacacattaaaaagcttgcattgaaaatctactctgatgaagagaagacgctagaaattgatgtacagggtgaaggaactgtaacggcagctgatattacacacgatagtgatgtagagatcttaaatcctgatcttcatatcgcgactcttggtgagaatgcgagtttccgagttcgccttactgctcaaagaggacgtgggtatacgcctgctgacgcaaacaagagagacgatcagccaatcggcgtgattccgatcgattctatctatacgccagtttctcgtgtatcttatcaggtagagaacactcgtgtaggccaagttgcaaactatgataaacttacacttgatgtttggactgatggaagcactggaccgaaagaagcaattgcgcttggttcaaagattttaactgaacaccttaatatattcgttggtttaactgacgaagctcaacatgctgaaatcatggttgaaaaagaagaagatcaaaaagagaaagttcttgaaatgacaattgaagaattggatctttctgttcgttcttacaactgcttaaagcgtgcgggtattaacacggttcaagagcttgcgaacaagacggaagaagatatgatgaaagttcgaaatctaggacgcaaatcacttgaagaagtgaaagcgaaactagaagaacttggactcggacttcgcaaagacgattgactagtttcccttgtgaactaggattttcgtgtgtttattattcagaaacagcattccaataaaggaggggacatcacatgtcatacagaaaactaggacgtacgagtgcacagcgtaaagctatgcttcgtgatcttacaactgatttgatcatcaacgaaagaatcgaaacaactgaaacacgtgcgaaagaacttcgctctgtagttgaaaaaatgatcacgcttggcaaacgcggtgatcttcacgctcgccgtcaagctgctgcatacatccgcaacgaggttgcaaacgaagaaaataaccaagatgcacttcaaaaattattctctgacattgcaactcgttacgaggagcgccaaggcggatacacacgtattatgaagcttggtcctcgccgtggtgacggagcaccaatggcaattatcgaattggtttaatcacatatttttgtgtatctaaagaagggcgggacagtttctaactggatctatgccctttttttagatactgcaacttttaatagagagaaaagcagagcattagctgagaggaggccggttttccatgaatcaaaatcagttgatatcggtagaggatatcgtatttcgatatcggaaggacgcagaaagacgagcactagacggcgtctccctgcaggtgtatgagggtgaatggcttgcaatcgtaggtcataacggttcagggaaatcaacactggcccgggcattgaatggtttaattcttcctgaatcaggcgacattgaggttgccgggattcaattgacagaggaatctgtttgggaagtgcgtaagaagataggtatggtctttcaaaatccggataaccaatttgtcggaacgactgttcgcgatgatgtggcttttggtttagaaaacaatggtgtaccgcgggaagaaatgattgagagagtggactgggcagtaaaacaggtaaatatgcaagattttctcgatcaagagccgcaccatctctccggaggccaaaagcagagagttgcgattgcgggggttattgccgcacgtcctgatattattatcttagatgaagcaacatccatgcttgatccgatcgggcgagaagaagtgcttgaaacggtaagacatttaaaagagcagggaatggcgactgtcatatccattacacatgatctggatgaggcagcaaaagcagacaggatcattgtcatgaatggcggtaaaaaatatgctgaagggccgcctaaagagatttttaaattgaataaagaacttgttcgaatcgggcttgatttacccttctcattccagcttagccagcttttaagagaaaatggactggctttggaagaaaaccatttgactcaggaagggctggtgaaagagctgtggacattacaatcaaagatgtagagcatcgctatcagatgaagacgccgtttgagcgcctagcactatatgatatcaatgcatcgattaaagaaggaagctacgtagcagttatcgggcatacaggctctggcaagtccactcttcttcagcacctaaatggtctcctaaagccgacgaagggacagatatcactaggcagcactgtcattcaggcagggaaaaagaataaagaactgaaaaaacttcgtaaaaaagtcggaatcgttttccaatttcctgagcatcaattattcgaagaaacagttcttaaagatatttcattcggaccgatgaactttggtgttaaaaaagaagatgctgaacaaaaagcgagagagatgctgcagcttgtaggtttatcagaagagcttttggacaggtccccctttgaattaagcgggggacaaatgcgcagagttgcaattgccggcgtacttgcaatggatcctgaagtgcttgttctggatgaaccgactgcaggtttggacccaagagggcgaaaagagattatggacatgttttatgagcttcatcaacgtgggaacctgacgacgatccttgtgacacacagcatggaggatgcagctgcatacgctgatgaaatgattgttatgcataaaggaacgatacaagcatcaggcagtccgcgtgatctgtttttaaagggtgaagagatggccggctgggggctggatcttccagaaacaataaaattccaaaaacaccttgaagctgtactgggtgtgagatttaatgagcctatgctcacaattgaagatgccgctgctgaaatccgtgctctttttcagggagagaagactttatgatggacagcatgattatcggcaagtatgtaccggggacttcacttgtgcaccggcttgaccccagaacaaaactgatcacgatctttttatttgtctgcattgtattcttagccaataatgttcagacatatgcgttgcttggtttatttacaattggcgtcgtttctttaacaagagttcctttctcttttttaatgaaagggctgaagccaatcatctggattgtcctttttacgttccttcttcacatccttatgacacatgaaggaccgattatctttcaaataggttttttcaaagtctatgagggcggtctggttcaggggatattcatttctcttagattcgtctatttgattttaatcacaaccttattaacgcttacgaccacaccgattgagattaccgatggaatggagcagctgctgaacccattgaaaaaattaaagcttcctgttcatgagctggctcttatgatgtcaatttctttacggtttattccgacactgatggaggagacagataagatcatgaaggctcagatggcgcggggcgttgattttacaagcgggcctgtcaaagatagagtgaaggctattgtcccgcttcttgtcccgctcttcgtcagcgcatttaaacgcgccgaagagcttgcggtggcaatggaagcaagaggctatcaaggcggagaaggacgtacgaaatatagaaagcttgtatggacaggaaaagacacttctgtcattgtcagcttaattgtattagctgctttgttatttttcttaagggcttagaggtgctgtatgagactgaaatgcacgatttcttatgacggacatttgtttaacggttatcaggttcagccgggcaaaagaacggttcaggatgaactggagaaggctttggctgtcctgcataagtcaaaagacagaattccggtcgtttcgtctggaagaacagacagcggggttcacgcagccggacaggtgattcattttgacactccactgtctatcccggctgagagatggccatatgccttaaatgcactgcttccggacgatatcgcagtcaaacaggcagaaattgcggatgatgggttccatgcacgatttagcgcagtcaaaaaagaatatcgctactttgtatacacggagaaacacccggacgtatttaaacggcattacgcttaccatttttcatatcgccttaatgtgcaggacataagagaagcggcaaagcatcttatagggacacatgattttacgagcttttgcgcggctaaaacagaagtgcaggacaaggtaagaacgatatacgaacttgattggactgagacggctgacggcctgcaaatgcggatcacaggcagcggtttcttatataatatggtcagaattattgcgggtactttgcttgatgcaggtattggaaaaatttctcccgatgaggtgaaatccatgctggaagcgaaggatcgcgaagcggcagggcgcacagcgccggggcacgggctatatttatggaacgtttactatgacaactaaaccaggtgtataatattttcttgacagagtctgcataaagttataagatatcatatggtatgtatttcaaccccacgataagccccggaacttattgtgttgtgaaatagaacgtaatcgaagtttattgaaaatgacagatcatttaggagggaaattcaatgcgtacaacacctatggctaacgcaagtactattgaacgcaagtggttagttgttgatgctgctggcaagactttaggtcgtctttcttcagaagttgcagctatccttcgcggaaaacacaaaccaacttacacaccacacgttgatactggagatcatgtgatcatcatcaacgctgaaaaaatcgagttaactggtaaaaagttaactgacaaaatctactaccgtcacactcaacatccaggcggattaaaatcaagaactgctcttgaaatgcgtacaaactaccctgagaaaatgcttgagcttgctatcaaaggcatgcttccaaaaggttctctaggtcgtcaaatgttcaaaaaattgaacgtataccgtggttctgagcatccacacgaagcacaaaaacctgaagtttacgaacttcgcggttaattaaaaaggaggttaccaatttggcacaggttcaatattacggtactggccgtcgtaaaagctctgtagcgcgtgtgcgtttagttccaggagaaggccgtatcgtcgttaataatcgtgaaatcagcgaacatatcccatctgcagctttaatcgaagatatcaaacaaccattaactttgactgaaacagctggcacttatgatgttttagtaaacgtacatggaggcggcttatctggtcaagctggagcaatccgtcacggtatcgctcgtgctttgcttgaagcagatccagaataccgtacaactcttaaacgtgcaggtcttctgactcgtgacgctcgtatgaaagaacgtaaaaaatacggtcttaaaggcgctcgtcgtgcacctcagttctcaaaacgttaattttacgtttcaaagactctcgaccttgggttgggagcttttttcttttaatataacgtggccagctccgcataaaaataacactgaatggacgcttgacggggttaaacaaattgtttgtttataaacggtctcactgtaaaaatcatgatatctttcatttttattcaattggaagttcggtcaatgtttattatcgttatgtgatcagaccagcttcatctaaccactgtatctcatccgttaaagttcactgctgattaactcggagaaacaatagctctcattgctaatggctttatgtaacgaagtaaaagtaaatctgatgatataaatcacatatctcctttgtgatttttttgcgtttttatgaacttttttctaaatatgcaaagggaaagcgatatcaatctagaaatatttgttatactctatacattaaagtaaggagaagattcatgaatgcgttagtagctcataatagcaaagcctgggataaaaaagtagaaacaggcaatgaatggactgttgctgctgagcagcaggttatcgaacaagcaaaaaaaggtaattgggatataagggtaacgccaatgaaagatgtaccgaaggattggtttccgcctatcaaaggtctgaaagtactctgtttagcctcaggcggtggccagcagggtccagttttggcagccgcaggtgcggatgtcaccgtattagataactcagaaaaacagttgaatcaggatagaatggttgctgagcgagatggtctcacgatacacactgtcaaaggaagcatggacgatttaagtgtatttaatgatgaatcatttgatgtcattgtacatcctgttgccaatgtttttgttgagaatgtcctcccggtatggaaggaagcgcaccgtgtgttgaaaaggaacggtgttctaatctcgggttttgtcaatcctgttgtatttctgtttgatacagaattagaacagcaaggtgttttaaaagtaaaacactccattccatatgctgacccagaagatcttccgaaacatagagtgaaaaaactgatcgaaaataatgaggctctggaattcggccattccttagaagaccaaatcaaaggccaaattgatgctggttttatcgttactggtttttatgaagataaaggtgggtttgtattagaccaatatatccatacatattctgcaacaagaagcgtgaaagtatgaaaagcagcgacctgttagaggggctgctttttttataactaattacagaacattcgttcctgaccctgcagaaagttgattttttatcgattttacaccttcatttgggcgaatttccaaccgaattcgggcattgtttcattatccaaacctcaaaataatcgataaaaggagagtgaatttatatggcagaagtactgtcttttatggatgtgaaacgccaaaaggattttgaattagaaaagaacttgctcaaagaactctctctgagacaaattatccagtctgttaaggattgtttggaaccattgtttccatttttacatgatgaacgagatattattactgaaggctgtattgattttgcgattgaagcttatttgttaggcgggcgttttgggatattcggctattacggagaatccatgcaaagtatcagtgcccgctctgcaagagaagaagaagagctacgtatggagttttttgattatctctataattggatacacgagcaatacgcaacatttgataaaaacacggtttatgaagcggcacgcaagttcattaaagattggtggacagcagggtttgttcaaagagaaaaacagtgtaagcttcgcatgcggtaatcatatttcccggccctgtcccatagttatgtaataacggacaagcgggaggggaagggatgaggaaaaagcttaaatggctcagttttttgctaggcttcatcatattactatttctgttcaagtatcagttcagcaataacgactcttggaagccgtggagcctgcccttgagcggtaaaatcatttatctagatccaggtcatggcgggcctgacggcggagcagtcggcggaaagctgttagagaaggatgttaccctggaagtggcctttagagtcagggattatcttcaagaacaaggagcgcttgttatcatgaccagagaaagtgatactgatctcgctccagaaggaacaaaaggctatagccgacgaaaagctgaggatctaagacaacgagtcaaattaataaaccattcagaggcggagctctatatcagcattcatcttaatgcgattccgtcacaaaaatggagcggcgcccaaagcttttattacgggaaatatgcggaaaatgagaaagtcgcaaaatacattcaggatgagctgagaagaaatctggaaaacacaacccggaaagcaaagcggattcatggtatctacttaatgcaaaacgtcaccaaaccgggggcgcttatagaagtcgggtttttatccaatccaagtgaagcaacgttgctcggtaaaccgaaatatcaagacaaggtggcatcttccatatataaaggcattttgcgatatttcacagaaaaaggagaccctccggagtaatggagggttttcttgtggttctaagcataagacacccgccatttatgtatgatataataataattgtaaacgaatacacaaaagggtgaggttcgatgataagagaagatgaagtaagaaaactagtcggagaaatgcgcgaaccttttcttcaaagacctctgggagaattggatgccgttaaggaaattaaaataaagcctgaaaaacggcatatcagtgtaaaagtcgctcttgcaaaaacaggaactgcagaacaaatgcagattcagcaagagatcgtaaacgtattaaaaggggcaggagctgagacagtcggccttcgatttgaagagctgcctgaagaaacggttgctaaattccgggcgccgtcagctgagaaaaaaacattattaaatatggataacccgccagtctttcttgccgtagcaagtggaaaaggcggcgtaggcaagtcaactgtgtccgtaaacctagctatttctctggctcgtctagggaaaaaggttggtttaattgatgcggatatttatgggttcagtgtgccggacatgatgggtatcactgtgcgtccaacgattgaaggagagaaacttcttcctgttgaacgctttggagtaaaggtcatgtcaatgggctttttcgtagaagaaaatgctccggtcgtatggagaggaccgatgctcggcaaaatgctgaataactttttccatgaagtagagtggggagaagtagactatatcgttcttgatcttccgcctggtacaggggatgttgctctcgatgtacatacaatgcttccgagctgcaaagaaatcatcgtatctacgccgcatccgacagctgcttttgtcgcggccagagcgggctctatggcgattaaaaccgatcatgaggtcgtgggggtcatagagaacatggcttattatgaaagtgcaaagacaggggaaagagaatatgtctttggaaaaggcggaggagataaactggctgaggaactaaatgtgcctttgctcggcagaatcccattgaaacagccagattgggataaggaccaatttgctccgtctgtttacgacgagaatcatccaatcggagaaatatatcaggacatcgcaaaaaaaatagatgcaaaaatgtctgtgcaggtataaaaggtgaaccgggattccagatcccggctttccctttattcactttctttggctgtgtcttttgctgcttttttcagctcatcttcgaactgctttttgtaaagcggactagaaagtgtttcgttaataacctcttctaaataactgcggaattcttggctttttgccagctggctgtactttttatccatgccgggatcctgcataacgctcatcagcatcttctggtaatctggatccttcatcagctttttaatcactttttcatgctctgtctgaagagttttggcaaagccctcagcaaaatcagtgtcttcaaagatgtttttccaaaattcttcaccttttttagatgtgagtgttttttctattgttcctttaattgcatcttggtcaatcaccagcgcttcattcatggcatcatcatttaataattccttaatagctttctttccatcatcagtttttaatatatcaacaaccatttttttggtctgatcatagtccatatccgctgcttggtcttttggagcgcaagctgttacagataataacaaaaaacagctcatcaatagcgttttggcttttgacatgcttaagctcctttcacatacttgtcttacctttaatatgattcatctgtttggaattatacataacaaaatatcgctgttcgcgatttttgaggggatgaataaagaaatgaaaagccgtggtttagttcgttttttcttttctattttagctgtcggagcgcttatcacgagtattgtgggttttgctttaaaatggggagaatatagagggctgtttcttacatttgaagcggggcagattttctctgttttattttggtttatcggtgtaggcatgattttcagtgtgatcagccaaatgggttttttcgtgtttttaacagttcatcggtttgcgcttgagatattaaggtcctcctctttgtggaatttgctgcagttgtttttcatcctgtttgttgcttttgatttaatgtacgtgcgttttttattttttggagagagcggagaatcgctggctggctatgcgtggttaccggtgtttttattgatctttggagtgattacagcttatataaagcaaaagcagtcctctaagaaaacatttgtgtcatcgttgtttttgatggttgtgattaccgcattagaatggttccctgcattaagagtaaatgatgaggactggctttatttaatgctttttccgttaatggcatgtaatgccttccaattgctgatgctgccgaagtttgcagcaaagtaattactttacctctgcggatttggcatcagaatttgcgatgaggtcacccacggttacattttttaatcctttttctttcagctgatggatgatatcaggcaatgcttcttctgtttgttttgccgaatcggaggcatgtaaaagaataatgtctccaccggaaacttgcttggtcacattgtcgatgattttttcaacgccgggatttgtccagtcttgagagttcacactgtaatgaacgactgtataattgtattgctttgcgacctttagaacattcttattgaattggccggtagggggtcttaatagctgtatgtctttgacccctaacttttcaaaggctgtttgcgcacggttcatgtccttttttatttcgctgctctctaaattggcatagtttttataagcgtagcccatgctcccgatttgatggccgtcctttacgatacgggccactgtgtcgggatggcgttctgcccaagaagctgaaagaaaaaacgttgcatttttaatcccgtttgctttcagagtattaagtatcggttctgctctctcatcgccccagctgatatcgaaagtaagtgaaatatctttagaatctgtttctcctttataaatggctttaggtccggtgtcagttgaaaacacgggaagcgggacagctctttggatataaaaaaagctggcagctgcaaatgcggcgataagtataataattaattgtttcacccgtttaatgtgccacacatagaagtgattcactgatgatgcctccttatcttgtccatcattcttgttttacatcttatgagcatggacaattgaatataaccgataaaatgtctcttcacatacagcctaaattgggtgttgaccttttgataatatccgtgatatattattattcgtcgctgataaacagctgacatcaactaaaagcttcattaagtactctgaaaaaagttgttgacttaaaagaagctaaatgttatagtaataaagctgcttcgttaagcggcggtaatgatctttgaaaactaaacaagacaaaacgtacctgttaattcagtttttaaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagctttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaancgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccgctcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctctggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcncgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgagcctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtnnnnnnnnnnnnnnnnnnnnnnnnnnnnnnnnnnnnaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacanctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcagtttattaattctaccatgtttgtttatgaagctttatattattccgcagtagctcagtggtagagctatcggctgttaaccgatcggtcgtaggttcgaatcctacctgcggagccattgcttccatagctcagcaggtagagcacttccatggtaaggaagaggtcagcggttcgagcccgcttggaagctttattaaatgtattattaccaaggtttctcataaggagaaagctttttttattgcgatatgcggaagtagttcagtggtagaacaccaccttgccaaggtgggggtcgcgggttcgaatcccgtcttccgctccatttatcctaacgggatattgtaaattgaattgcgcccgtagctcaattggatagagcgtttgactacggatcaaaaggttaggggttcgactcctctcgggcgcgccatatcttttaatagaatagatagggaatcgggaagtagctcagcttggtagagcacatggtttgggaccatggggtcgcaggttcgaatcctgtcttcccgaccattttttatggggccttagctcagctgggagagcgcctgctttgcacgcaggaggtcagcggttcgatcccgctaggctccaccaaaagttttttaaaaaagttattgactttgaagaagtgacgttgtatactaataaagttgctttaacaaagcggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacctaaaaggtggcttcggctaccacttacagatggacccgcggcgcattagctagttggtgaggtaacggctcaccaaggcaacgannnnnnnnnnnnnnnnnnnnnnnnnnnnnnnnnnnnnnnnnnnnnnnnnnnnnnnnnnnctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccgctcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcacgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactcnnnnccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagctnnnnnnnnnnnnnnnnnnnnnnnnnnnnaaaccgacacaggtaggcgaggagagaatcctaaggtgatcgagagaactctcgctaaggaactcggcaaaatgaccccgtaacttcgggagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccacttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaattgcacgttagtgtaatttttttaaaaagttgttgactttgaagaagtgacgttgtatactaataaagttactttaacaaagtggacaaacaaaatgatctttgaaaactaaacaagacaaaacgtacctgttaattcagtttttaaaaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttggtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggactgtcttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaagtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaagtaatacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatctcgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaatagggaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcgggggtttccccctgtgagagtaggacgccgccaagcaagcttaaacccagctcattgagctgggttttttgttttatatctgtgccgatttgctttcgtcagtatccattttatcaagcttctgctttttaagttttctaatatttttgaatcccaatacaatcaccagcatgatcaacatgagagtcataaataatcaaaatgcaggttgtacgggagactcatccagactccatccgactgcgattggcaggatagagccgccaatccattggtagcgagcagcatgcctgtcgtttgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatttgttcggaaaccggctcgggttgccaaatgggagaaaagatattactgtcattaaaacgattcttggtttcatccggatatgataaaatgtctcagactatatatttgagccatttttttcttcagcattcatcttgcgtaattgataaaaatttattatgatactctttgtatgacaactccttgcctcaatacaatatactcaacgtttccccgttttctccggtcgtttttcttttcattttctcccgtaaaataaaaaaagctcccaatacaatagatatggtgcggataaatttttactaaaaaggagtcgttatatttgaatgatagttttacattaaaacagcaatggttcggcaatatccgaaaagacattcttgctggcattttagttgcgttagcattaattcctgaagcgattggcttttctattatagccggtgtggatccgatggtcggtctttatgcgtcattttgtatagccattattatttctatttttggcggcagacctggcatgatttcagctgcgacaggctcaatggcagtcgttatggtgtcgctggttgctgatcatgggcttcagtatttatttgcggctacgattttgacaggtattattcaggtgattttaggtatcagtaaaattgcaagattaatgaaattcatcccgcgttctgtgatgatcgggtttgtgaatgcgctggcgatccttatcttctcagcgcagcttccccagtttgaaggtgcttcttggagcatgtatgcgatgcttgccgggtcgttggttattatttatgtgctgccgagatttacgactgctgttccgtctccgcttgtggcgattattgtgatgacaataattgcggtcactttccatgtggatgtgcggacggttggtgatatgggcaatatttctagttcattgcctcatttcttaatccctgatgttccgtttacctttgaaacactgcaaattatttttccttattcaattgctttagcgtttgtcgggttgcttgaatctttgctgacagcacagattattgatgagatgacggatacggacagtgataaaaataaagagagccgcggacagggaattgcgaatatcgtgactggattctttggcggaatggcaggctgcgctatgatcggacaatctgtcattaatacaaaagcgggcggtcgcggacgtttgtcagcatttgttgccggtgcttttctgatgtttttaattgcggtgttaagtcatgtcgtggtgaaaatcccaatggcggcgttagtagctgtaatggttatggtgtctgtcggcacttttgattggtcttccttaaaaggtctcaaaaaagcgccgctcacggactcgattgtcatggttgtgactgtggttacggttgttgtgacggatgacttatctaagggtgtatttgtcggtgttcttttaagtgccgtgttctttgtggcaaaaatctcgaagctgaaaatcgtttctcatgcagaggatcaaaagcttagaacgtatcaagtgaaggggcaaatcttttttgcgtcagtgactgatcttacgaatgcgtttatatatcaagaggatattgagcgggttgtgattgacttaactgaagctcacgtatgggacgattctggtgcggccgcacttgataagattgttgcgaagttcaaggaacaaggcattgaagctgagttaaaaggtttgaataaagcgagtaaatctctaatgaaacagatggcataaaatagagaagcccagatgaatgagatctgggcttttttatataacatacacttaagcagcattgatataatagagagaagagaaattttaaataggggacttgcatatgatgcttcagaagctgaaccgtgtattggggagagtgatgccgctgttgacgccgactagtgtggtgctgggcgtgctgctgtctcagtttttaaatgggtatgaatgggctgtgccttggatctttgcttttattacgtttgcaggcagtttgagcgcgaactttcaatctttgagacatgcattgtctcatcctctccctatgattcttgcactattcgttcttcatattttcatgccgctttttgcttggggcagcggccatcttatatttaaaggtgatcctttgacgattaccggtttaacattggctgttgtgattcctacggggattacaagcttgatttgggcagcgatgtacaaagggaatgtcggtttgacactttcgattattttaattgatactgtgctgtcaccgctaatcgtaccgctgagtctttcattgctggccggcgctcaggttcacatggatgtgtggggaatgatgaaaggtctgattgtaatggtcgtgattccttcttttttgggcatgctgtttaatcagatgtcatctccagaaagaactgcgtctgtgagcagtgcgctgtcgcctttttcaaagctttgcttgatggcagtgattgcgattaacagttcagcgattgctccttatttcaaatccattgatttgagatttgcaggaatagctgtaacggtattctttatcgcgttaacaggctatgccgctgcttggctgatcggaaaaatgatgaaaaggcggcaagaggaaatagtctctcttatatttacgggaggcatgaggaatattagtgccggcgcagttcttgccgttacgttcttcccgtctcaggttgccgttcctgttgtgatcggcatgctatttcagcagatattggctgctttgtttggctatatgctgaatcgttttgaattaaaaccaatgttgcagaaagcataaaaaaaccgctcatagggttgagcggttttttccgtatagccattcgagcgcgttgatgaactgtttgcagaaatacttgcggtggtgcaccgctcctttttcaattgaaagatacaactggtcttcagtgaagcctttttcttttagactttgatgaacttgctttgtttttttcagcatatgtcgctgaatggattgtttttcacagccttcttcactcccgatagacatgaaaacacgtgcagtgccaggctttaaagaagatatatgaatggtttccgctgcgttctcgtaccagtatgaacctgatatagagcctattttcccgaacattgacggatattttaatatggcgaacattgagatgaggccgcctaatgaggcaccgatcattcctcttgactgcggttccctggtgacgttccagttttcttcgattagcggaatgaactggttcgttatatcagacagatagtgatatcccattccgccgaagtccgtgaaccgatcactgagtgatgcagccggccatggggtgtattcatcaagccggttttcgggttcgataccgatcagcacgagttcagggagcctttgctgttgaaaggcgctttctagtaattcgatttggttttggaacaaagaactgccatcctgcacgtaaacagcaggaaatcccccgctgtctgtgctgtaggaaggagggaggtacagcgtgaacctcctgttgccggctttgtgttctgaaagagatcctttcaagcattctccccctttttttgcttgaaaagcagatataagaaataaggaactccgaggatcgccaaaatgatgcctgcgggcacttctgcgggctgaaaaaacagttttccggcaaagtctgcgcttatcacaagaagcatcccgattaaaccgctcagtggcaggatatagcgatgttcgacgccagccagtctccgtgagatatggggagcaattaagccgacaaacgccatgcttcccgctacggagacacaggcgctgatgattgctacacaggctacgagcaggatggttttttctttatttgatgaaatgccgaggcttctgactgtgtcttcatcaaaacgaatggtgtcgagcaggcgggatttgccgataagaatcggtataaacagcagcatccatgggagaacggctgtgatatacgtccagttggcagaccagatgcttccgtttttccacaccatggccatttgatagtcttgcgggtccatttttaaagataaaaacaaagacagggcgctgaatcctgaattgatcgcaatccctaccagaataattcttcctgaatctaaattgcctctgtgccatgcaaatatgtaaatcaggatcgccgcgatgagcccgcctatcaatccaaagagcggcattcccatcgctgcagctatggatgtcacttccttctggccttggaataagagcataaacgctacaatgccggctcctgcccctgcgttgattccgagaattccaggatcagcaagcccgtttctcgtgatggcctggataacagcgcctgcaatgccaagaccgagtccaataatagcagccatgacaacccgcggcagtcttaaatcgaacaacaaaatttcatactgcggattcgggtcgatttgaaaaagagtggagagcagctcagcaggacgaacagaaaatgatccgctcgttaagctgaaatagctgacaacaagaatcaaagcgctgaacaatgcatattttttagccattttgctcccctccttttcgtttaattaaataaaggaagaaaggtacgccgataatggatgttacgacctcaatcggtgtttcaaacggatagttgataaatctgcttgcgagatcacacagggttaaaaagattccgcccaaaatacaggaacacggaatcagcctgctgtaatcagagccgacgagaaatctcgtgatatgcggaacaaccaacccgacaaacgcaatttttccggccagcgctacggcactgccggttaaaatgatgacggaaagcatcgccatgattttaatggtttttttcttttgccccaggcttttagaaatgtcgtcccctaatgatacagcggttacctttttgctgagagaaatggccattatgatgccaatcaggaaaaacggagcggcaagcttcaggaaatccggactcatttgatgaagtctggcactgtaccagaaactgagatcctgagaaatttgaaaataaatcgacatggccgctgataagctgctgagcagcatgcttgtgactgtgccgatgatggcgagctgcacgggggtaaatccgtttggcatcatggcggcaaggccgaatactaacacagctcctaacgctgagccgataaaagagtatatcatcatttcaatcgaagatgattgcgggagcagaaccatgcaaagcgtaatgataaacgctgaaccatctgaaacacccataatggatggcgaagctaaataattgcgcgtgatgccctgcataagcgctccagaaacagcaagggctgcccctatgagcagagcgccggcagcccttggaatccgggagtgccatataatttgatggtctgtgtttcccggatcgaaatgaataagagatgtaaaaacaatatctgtgctaagatgctttgccccataaaggattgaaagcaaaagtgacagcgctatagcaaatggagaagtaatcaatatgatacgtgtccactgttttgaatacatacaaaaacctactctgaattagttttgtgtcaatttttcagcagccgctttcaggaaacggactttgctccaagctgtgccgccttgtgcgagagggtccactgagttgacatacacatgatcttctttgactgctttaaggcttttccagattggatttttctctaaatcttttaaggcatcaggtttgtctgcattttcatcatcagaaaattggacgaaaatatggtccgggttcatttcacttaatttttctaatgaaatcagctcttgcgcttttgcagcttttacttcgttcggcgccttaaggcctaaatcaccgtatagtgtggagttgaaatacacctgttcagggtaaatgtaaatgttgccttgtctaattctaatgacaagcgcttttgaatctttcgctttatcgttgatttttgtttttgtttcttttagatcctgttcatagtctgcaataattttctttgcttttttctcttttccggtcagttgggcaagcagcatcatgttttccttccagtttgaagagatatgagaaactgggatcgtcgtgcctgctgtgctgattttttgcagcgttttttccggaaactttgttgaagcaaggataacatctggcttcatttcaagaatcttttcaatatttggctccattttttctccggttggtttggctttatcagtgatgtctttgaacatatcagggaatttgccggagaatgaaattgcgccttgcggataaacgtcaagcaatttcgcgtcttccattgattcaacgcttcccgtaatggcgattttgtctgtcggtacagttacttcatatgttttatcaaggtattcaattttcttcttctcagatgctgtgccgcttgccttgctggcagttgattcatttttgctgccgcaagctgccgccgtcagcgcgagaagtaagattaataaggtaagagatatctttttcatctatagagcctcctgttcaattgataactattatcaattggaattatagagaatgaacagatataacaccatggacaaattcctgatttatcatggacaatctccggataataaagaaacagtttgctgaacgatgcgttcgtgcccgcaagctgagtattcattccacgggtcaagggatagaagataaacacgcttattccgtaccgcgcttaggttttgccatgcttctgtctgctgtaattgctggtagtaagctatagtctccggctctttaaaaagaaaaagcatcatacagtcagcttggtaatttgcgatattttctaacgaaatcgcttgttctgaaggtgtgtcagccgttgttgccgagctgaatcctaaatccccaaagaaaacttcgcggacacttcggttatgtgccagatagaagttttgcttatgcagcctcaaaaagagaaaacgcagcccttgaacgtgttgaagtgtttttttggcggctgttgtctgctggtcataatccgctagccacttttctgcttcggactcctcctttaaaaatgaggcagtttgcagaaagtgggttctccagctttcttctgaaggaaggtacatgacttctgcgatgcgattcaggcgatcttgttcttctggagaaatagaatccatgctgacaatcacatctggttctgcctgtgataacgtgtacaggttttcttcccacttttcattaaaccggtatgcactgagctggacgggtatatctgtcgaataatgctgatagtagtaagacgtccattttggatgcagagcggccgcaaaaggtatgtggtgaagggggatgagatggcccattgtgccccttccgtatgcggcgattttctttcggcgttttttcatatagcttgtaggtgaacagcctgtatattttttaaagattctgctgaaataaaattcatcttgataaccggtttggtgtgcgatttctttcaatttgcagtttgattttgccatgagcagttttgcctttgtgattcgtgttttcgtaataaattctgttacgctctgtcctgtccattttttaaagctttcactgtagtgtttggcactgattcctgccatttgcgacagctgggcaagcgtgatttttgtatcggcatgggtttcgatatagtgttttgttttttcgattgctgaatgtgtatccgtttgatcagataaactggcagtaaagaggtcataaatcaggctttgtacttcaatcccacattttagctgagaaagctgagacgattcattccatagtgcggcaagctcttgaagccggacggcaagattttcgatatgtgaaacatttataagcttcagtttggctaattccgattctgtgcacggtgtgaaaatatcttggccggcttccttgatatagctttgaagcctgatcagacaggcatctatatgtccatcggctgctggcgtaaagccaaaggtctcgttaggcggacaaacataaagtgtctttttttgcaaaggattggtgtttgttccgatcgaaatatagccgtttccttttaaatgaaaaatcagcacgaatgaatcggctaattgctgttctgagaagagatcacttgtcttttttagatattcaatttgtaccggttgataaatcactgcattttgcacgattagaccaccttttcagaagctttcaattgataatcattttcaataaaaattgtaccaaataaatgaaagttttcctatataaagcgggtgggtttttagtatgaaaaaaacccttacacatgtgtaaaagtaagggtctttcgttcggtaagaatatgttacacgtgtaacatacgatgcttacgttctaataaatgagatatttttttcttgttttgctgaattgttggagtgttttttcatagctgtttatgatgttctcaatcgaagttccattttcaatttttgtcctgatccagccgttgcctgccagtttatcgaatgaacctgttgacaggaactcaaaatcctcaggatagagatcgtgtatggttttaatgactgaaagacccgttttaacggcttcaaacttatctctttctgtcacatagagctgcacaccgtggcaaagcgttccttgatgtttagaaaacgtcggtgtgaaggatgctgccctaaatgtaacgcccggcaaatggaggctgtttaatgtttcttcaagttctgtgcttttgataaagggagctccgatcaattcgaatggctttgttgtccctcgcccttcggatatatttgttccttcaatcagcccggttgcaggataaacaaatgtgctttccaccgtcggcatgttaggcgaagggaggacgaaaggcaatcgggtatcgtcaaaatccatttttcgcttccagtgtttcatttttaccactgtaagatcggcattaatactaaattctttgttgaacagtaaagccaattcgcctatcgtcatcccatgcttcaatggaatgggatacaatccgacaaatgaggcgtagtcaggttctaagattggtccttcaatatgattccctccttgaggattcggacggtccaacaccataaatggaatgccgttttctttagcggcttccattgcgtatgccattgtataaatgtacgtgtagaaacgggtcccgacatcctgaatgtcaaacataagaatatcgacatttttcagcatttctggagtcggttttttcgtttttccgtagaggctgtatacgggtaccccggttttttcgtcaatgtaagagcctacttcgtctccagcctgggcgtcaccgcggacgccgtgttcagggccgaataaagctgtcagtttgatatctgggttctcgtaaagaatatcgacactgcttttcagagatgcgtttactccggttggattggtgatcagtccgatgcgttttcccttgagctgttttttatagtctggcaagagcgtgtctataccggtctggactttaggctttttagccgtttgattctttgaatcgggtgaagcagaggcagcggttatcgttccgaacatcatgagccctgtcagaaaagcgaatattgtttttctcatgtgtccctccttattaaagcggtcttcccgttttgatatttaatccgtagccaaatgggtaaagggtgttccctggtttcgtgactgacggaatgtcaactggaagtgtgcctttaggttttgcctggccgaatatcgccatcactccggccggaatattaggttgaagataacggccatttgcgtatcctttaaagccatagactgcaatcagtgcctttgtttcttcgaaattggctgcgtcataggggttgcgcaggctcattaagacaaatggtttgttgtgctgcagtgcggctttcatgacagctctcggaaacacggtggcccatttgcttgaatctgatattgtgtcgtcgatgacaccgtcgttgacgacaggatcatttttgacgacataggagccggttatgatataatcagccttttttacttgttttgcatgctcggccttaaatacttggttggcaaaattcattttgtcgacagatacgggtttgattttctttcgcttgatgagatcgtgaatggtttgttcgattgaagcagtttgttcttcgtaaggtgccacaattaagattcggctgccttttttaggcttgaatggcaaagtgtgctgttcattttttaatacagttactgctttttcagctatttttttctctgctttcaggtgctgcttgcttcctacgatttttttggctttggctattttttcttttgtactgtcgctgtttcgcgctggatacatgccgcgttttattttcagggaaatgattctttcaactgaattgttgatttgttgttcaggaatatccccgtttttcacggcttctttcaaagcttgaataacacgtgcgaatttctgttcttctttcaatgaagtgactgaggctggcattaatgcaatatcgacaccagctcttacggccatgaccacagcctcttcctgtccgaaatgatctgcgattgccttcatattgagtgcatcggtaacgatcacaccattaaagcccatttcctgacgaagaagacctgtcatcactttttttgaaagtgtagctggaaccaaaatgtccgatccatcgagtttgcttttgtaagtggtgtcatcaaaggcgggaaactgaacatgggctgtcatcaccatatcagcaccagcatcaattgctttttgaaaaggataaagctcgacctcacgaagccgttcttggccatgggaaacgagcggcagtccataatggctgtcaacgtccgtgtctccatgtcccgggaaatgtttgagggcagacgcgatatcctgccgctgcaaccctttcatcgtgtataaaccgaggcgtgatgtcagttctcgattggagctgaatgaccgtacgccgattacaggattattaggattattgttaatgtccacgacagggctgaaatctgtattgatgcctaaggcagagagctctttcccgatgatgctgccggtctgatacgcattgattctgcttctggctgcgcccagtgccatattccctgggaaattagtgccctcccctaaccgcgttacaatgccgccttcctgatcaatactcagcatgagcgggatttttggacttgccttttggtaatcgtctgtcagttggacagtttgttttgttgtttttacattttctgcaaaaaggatgatgcctccgaattgatatttcttgacgaggctggcgacttcatcattcatttctgtaagggcttgcggagaggactcgccttccttttgccaatttctaaaatcaggcatcagcatctggccgagtttttcatctaacgacatacgattgacaatctgattggcatcgattgcacgtttggatgcagaggcttctgtctgtctggccccgaaaaagcatgaaagaaagagaacggctgaaaggataagcggaaagacaggtctcatagaaacttcctcctatcgtctaatcattcactccatcgcttcataaatcgcggttatgacacttccataactgcctgttgcaaattgatcaccctcaaagacgtttggattttcttccggatcaataactggtgtatgctttttatttgttaacaatgcgatgcctaaattgtatgctggatcaataattgtaactgtccctgtccagccggtatgcccgtaagcattttcactggcatgagggccaaacatccattccatgcttttacttccgttccgcctccagccaagagcgaatgtcgggtctgttgctgaaggtgctgtaaacaggtcggctgttttctgatcaaataaagaaatgtttcggtatgaacctttgtttaacatgacttgcagcagtatggccatatcatctgcatttgagaacaatccggcatgcccagacacgccatccattgagtaaaacgctttttcgtcatgcacctctccttgcagcgtgtttgtgcggatgttagggaattgaataacgccgtcacgtgtattgcccattcgttcagtagctgcgaactgtttcggtttaaagcccttttgcagcggattgtacaaggtatgcttcagcctgagcggtttgtagagctcttgctccgtgtagacatcaagcggtttgccagtgagtttttcgacaatacacccaagtagcatatatccaatgtcactgtatacgtgttttgtcccggtttgataatcgagcggaattttcgtcaaatattcaatcgttttgtcccgttcttgggaatagtacttgccggctttttccggcgtgtaaaagtaaaagcttgatgggagccctgattggtgctggaggacatcaatgacacgtatcttgtcttttccttttatgaggtcacccggctgatccttgaaacccggcaaatatgcagaaactttttcatagacgtcaagttttccttggctgactaagcgctgcaatacaaaatttgttgcgtacatttttgtatttgaggctaagtcaaacatcgtgcgggttttcattttggccggacggcgcagcagttctgacccttcgtactttttactgtagccgtatgcttctttttttatgatgcgtccatccttcaccaccacaagaacggcgcctggaaatcctgctgcaatatcccgttctatcatctgatctaccttctttagcttcttcgtcgagaattgtgcagtttctgcatttatggttttcggctcaaccaagttgtctgctgtttgtgcgaaggtttcatttggcgcgaatatcgatagggttaaaatggcactgaatatgaacagtgtctttgttttcacaggctagcccctttctgtgcttctatcccgtttactatccctaaaacagaaacaatttaatcgaactgagaagccatttcatctttatatccgaatgcataggtcaataaaaagccggccgcgtaggaaataaagagcccaacgatatacaggatgatttgcgaaggcaggactagaaaggaaagcggcagtccggagacaccaatcgcaatggtggctacttgaaaatacgcttgaaaggcaccaccgattccagctcctaaacatgctgttaaaaacggacggccaagcggcagcgtgactccgaaaataagcggttcaccaatgccgagcagtcccgatggaagcccgccggcgattgctttcctcagtgttgtttttttcgtcttcacgaaaacggcaaaggccgcgcctacctgtcctgcacctcccatagccaaaatagggagcagaggatcattgccaattgaattgatcagttccatgtgcacaggcgtcaagccttgatgcagtccggttacgacgagaggaaggaaggttgcgcccagaataaagcctgcagcgatgccgccgatgtccaggatggacagaaggccggatgtaatagcatcagagatgaatccgcctaaaggcataaatacgacatacgttacgattccggtgattaacagtgaaacggtgggtgtgacaatgatatcgagtgattgaggaataaaacggcgaataaattgttcggtgtaagcaatgaatatggctgcgaaaaggacgccgatcagacctcccctgcccgggagaagctcttctccaaataaactgatttttgcgatctccggattgataatcaagatcccggccaaagccccaagtgcgggtgtcccgccaaattctttcgaagcgttaataccgacgagaatgccgagataagtgaacagccctgatccgatgactgtcaggataaccgcaatttgtgagtctgcagagagccagcctgcttgaataattgctttggtaatcccagtaattaaaccggaagcgactagagcgggaataagagggataaaaatgctggcaattttacgtaagaaaagtttaaaaggagtggcgttttttcgattgatatcggctttctttttggccgcagcttctttgacatcggcaccttcttctgctgacacgagctttgagaaagcagctgtaacatgattgacgactcctgtgccgaggataatttgtaaggtttcagcttcaacgacccccaatacgccgtcaagctttcttaaaccctgagcatctgctttgctttcatcgtaaggcgtaatgcgcaggcgtgtcatgcaatgcgtatatgaagaaatattggattttcctccgcatagctcaaggattttctgtgcgagatgatggtagttattttctttgctcattaaaacccctccccttcaagatgccttattttattctcatagattgtatggctgctctcgttttatctatataaccggttgtcgtttcatactgctcagccgccatgcctaaaaacaaaacatcaattataaaaagctgggcgaggcgggaggaagtggctgcacttcgaatcaaggcttcattggaatgggctgtatacaaagggacatcagccagtgcggagacggatgtctgactgaattgtgtgaggctgatcgttgtgatgcctttttccttggccatggcaaacagttcaatgatttcctgtgtctctcctgaaaacgaaatggcgaatacgatgtcgtctttatctgcatttgcgattaaagatgccacaagatgagtgtctgtaaacgcggttgcttgtttatgaatgcgaagccacttttgctgggcgtccttggcgacaatgccggaagccccgaggccgataaaatgcacggtatgagctttgagaagcagagaaaccgctcgttcaagctctttgtagtccatcaggtctgaagtatcctgaatggcttgaatggcattgccggccgttttttcggaaatggagggcagcggctcgtggggaacaatatcccggtagccctgaaacgtaggctttgccagatcgcccgctactctcatttttaaatcttgaaatccttttaaaccgagtgatttgcagagcctgatgacggcagcgtcacttgaattggctaaggcgctgatttcgttgaccgtgctttcgattgctttgtggggatgggctaggatataatctgcaagtttgcgctcggatggagggagcttatgcttcattgattggatgatcgctaaaccgcctgtggccattctagttctctccttatcatggatggtaatgttcgattgctttgtcaatgaaaccgtttgcttcatcgagtaatgtctttgcttgtttctgatctgtgcttgttttgagcatgacgattgctgttttgacgtgatgatcggcttgttccagagtgtatctggctgtgtcgtatgaagcgtttgtaaggctttggataatgctgatggcgcgttcttttagttttttgttgctgacgttgacgtctaccatcaagttttcgtaaaccttgccgattttgaccattacagcggtagatatcatgtttagaatcattttatgagcggttgcggctttcatacgtgttgatcctgtaatggcctcaggtccgacgacaacctcaatgctgtgatccgcatccttgctgatggcggaattttcattacaagtaagggcgatggtgtgtgctccgactttgcgggcgtatcttagggcgcctgcggcgtagggtgtgcggccgcttgctgcgatggcaatgacggtgtcatttgaagtgagctgtatgtttcttaaatcttcagctcctgcttcttcactgtcttcaatgccctctgctgcctgtaaaaaggcttcggggcctccagccatgattccgatgacctgagctgggcttacgctgtaggtgggaggacattcaacagcatccatgacgccgagtctgccacttgtgccggcgcctgtatatatgagccggcctccattttgaaacgattcataagcgcagtctacagctgttttgatgtcggggagaacctcttgaacggctgcagcgactttcatatcttcgttgttgatcattttgaggatgccgagagtgtttgctttgtggatttcaactgtttggctattgcgtgattccgttgtgagacggtgaaggtttaatggttctgacatgaggatgccccctgttttaaaatgatatatctcaatattcagtatattcatttctgttatgatatttcaactatgtttttaaatttttgaaattttatttcactcaagactataagaaatgatgaaggatcaactgttctccaagcgggccgattcttcgccgtcctttatcaaggaacccgcttttcatataaaggtgttttgcgcgtatgtttagatgattgacggccaagatgatttcgtcacaccatggaaaatatccgctcacaaaagcgggaagcaaaagcatggcttttttcgcatagccttttccgtgatgcacagcgtttaaagacagggagctgagcagtaaagcaaatggattgttagaataggaagcaagcgtttcttttgatgcatgtaaaatgaaaaaaccgactggaaggtcgtcttttaagatgacaaccgggtatcggtcctgtatgcccagagcctgagacagcacctctttcgggagggaggtaaagcgtttgtcatcgttggtgagcgtgaatgattggagctcgggcaagtgttcaggcttatagaaggataaagaaatgtcttgagtcatggggtgacctccttacaatatgtcgttaagctcgttttccgaaatgacgcggtagcccgcttgttttaacagtgcggcggttactccgctgccggtgatttttttgccagagaatgtgccgttatagataaaaccgcttccgcaagatggactgttttcttttaatatgacggcagaagcgttgatttcttttgcgtaagccaatgttttcgcggcgccttccatatatagttctgtgacgtcttctcctgaagctgtcacgattttcgctgttccattgaggacatcctcgccggtgcctcctatgatttctgcgggttcgcgtggggtagagaagccgccgagaagttcagggcaagccataactgctttcttttcatcgacgagttttctgattttctccgacgctgcgtgagagccgttatatctgcattcaatgcctccaaggcaggaactgactagaatcatattgtttctcctctcttgctttgcttgtctctatcataaaataaatggctttagttgggaggctttttcagttaaaaaaggagttaaaaagtttgaaaataaaaaatttaattttcctctttacaaacagggggtgacctgtatataataacttttgtcagctcgacgagaacacaacggcccgttggtcaagcggttaagacaccgccctttcacggcggtaacacgggttcgaatcccgtacgggtcaccatttggaggattagctcagctgggagagcatctgccttacaagcagagggtcggcggttcgagcccgtcatcctccaccatcttgccggtgtagctcaattggtagagcaactgacttgtaatcagtaggttgggggttcaagtcctcttgccggcactgttttttcaaaattttatgtggaggggtagcgaagtggctaaacgcggcggactgtaaatccgctccctcagggttcggcagttcgaatctgcccccctccaccattattgggctatagccaagcggtaaggcaacggactttgactccgtcatgcgttggttcgaatccagctagcccagtcacagacacctttgatcaaaaggtgtcttttttcttttcggaaaaatcattccaacttctaactgttcagtctgtataataattttaaaaatatgttaaggtagtttattcacgaattaccatctacaccctgccaaaaatttgataaacttattttataaaaaaattgaaaccttttgaaacgaagctcgtatacatacagaccggtgaaggcagaggttagataaatatggaaatgatgattaaaaaaagaattaaacaagtcaaaaaaggcgaccagaatgcatttgcggacatcgtagatatttacaaagataaaatttatcagctttgctaccgtatgcttggcaatgtgcatgaggcggaggatattgcacaggaagctttcatcagagcgtacgttaatatcgacagttttgatattaaccggaaattttcaacttggctttatcgaatcgcgaccaatttgaccattgaccgcattcgcaaaaagaagccggattattacctcgatgcagaggtggctggtacggaaggcttgaccatgtattctcaaatcgccgcagatggtgttttgcctgaagatgcagttgtgtcgctggagctctcaaacacgatacagcagaaaattttaaagcttcctgacaaatacagaacagtcatcgtattaaagtatattgacgaactctcattaattgaaatcggggagattctaaacattcctgtggggactgtgaaaacgcggattcacagaggcagagaggctcttagaaaacaattaagggatctttaagtggggtgatgaaatgagctgtcctgaacaaattgtgcagcttatgcatatgcatcttgatggagatatccttccaaaagatgaacacgtattaaataaacatctggagacatgcgagaaatgcagaaagcatttttacgagatggagaaatccatagcgctcgtacggagcacatcgcatgtcgaagcccccgcggattttaccgctaatgtcatggcaaaattgcctaaggagaagaaaagagcttctgtaaaaagatggttcagaacccatcccgttatcgcagctgctgcggtattcatcattttgatgggcgggggtttttttaacagctggcataatgaccacaatttcagcgtgtccaagcagccgaatcttgtggttcataaccatactgtgaccgtgccagaaggtgagacggtcaaaggtgatgtcactgtcaaaaacggcaagctgattattaaaggcaaaatagacggggatgtaaccgtcgtaaacggcgaaaagtatatggcctctgctggacaagtcaccggtcagattgaagaaatcaatcaattattcgactggacatggtacaagatgaagtctgcggggaaaagtgtactcgatgcattcagtccgaacggagaagagtaaagcgcgttagccgctttgctctttttttgcgggctgagagggctggcacatttcacttgctaaatcgaaatgtggtataatgggctcgctatgtaaagtacatatgcgtaacacgtaaaacacaaaatacgaaatgactgaaatcttggaggacgaggaaatggcttttgaggatatcccttttttgcagtacctcggcaatgccgttgatattctccttgtttggtatgtgatatataaattgattatggtgatacgcggcacgaaagcggttcagctgttaaaaggaattgtagtcatcgtgcttgttcgtatggccagccaatatttgggcctcagcacacttcaatggctgatggaccaagcgataacatggggatttttagcaattattattatttttcagcctgagctgagaagagcgcttgaacagctaggccgcggccgctttttttcgaggagcggcacgcctgttgaagaagcgcagcagaaaacgattgaggccattacaaaagcgatcaattatatggcgaaacgccgtataggcgccttgcttaccattgagcgggatactggaatgggggattatattgagaccggcataccactgaatgccaaggtcagctctgagctgctgatcaatatttttatcccaaacaccccgcttcatgacggtgcggtaattatgaaaaataatgaaattgccgcggccgcctgttatctgccgctttctgagagcccgtttatttcaaaagaactgggcacgcggcacagagcggctgtcggtatcagtgaagtaacagacagtttgacgattattgtgtctgaagagaccggcggcgtcagtgtggcaaagaacggcgaccttcacagagagctaacagaagaagcgctgaaagaaatgcttgaagccgagtttaagaaaaacaccagagacacttcttctaaccgctggtattggaggggcaagaaaaatggataaattcttaaacaaccgctgggctgtgaaaatcattgctctgcttttcgcgctcttgctttatgtggcggttaacagcaaccaagcaccgactccaaaaaaaccgggtgaatctttctttccgacatcaacaactgatgaagcaactctgactgatatcccggttaaagcgtattatgatgatgaaaattacgtcgtgacgggtgttccgcaaacggttaatgtcacgataaaaggctcgacaagcgccgtgaaaaaggctcggcagaccaagaactttgaaatatatgctgatatggaacatttgaaaaccggcacacataaggttgagcttaaggccaaaaacgtgtcggatgggctgacaatctcaattaatccgtctgttacgacagtgaccattcaggaacggacgaccaaaagttttcccgtagaagtggagtactacaacaaaagcaagatgaaaaaaggctattctccggagcagccgattgtcagtccgaaaaatgtgcagattaccggatcgaaaaatgtcatcgataatatttctcttgtaaaagcttcagtgaatttggaaaacgcagatgaaacgattgaaaaggaagcgaaagtgactgtctatgataaagacggaaacgcgcttcctgtcgacgtggagccctcggtcatcaagattaccgttccggtgacaagcccgagtaaaaaagtgccctttaaaattgaacggacaggaagccttcctgacggtgtcagcatagcgaatattgaatccagccccagtgaggtaacggtttacggctcacaggatgtgttggattctcttgaatttattgacggcgtcagcttagatttaagtaaaattaacaaggattccgatatcgaggcagatattccgcttcctgacggtgtcaaaaaaatctcaccgtcaaaggtgactttgcatatagaagtcgatagtgaagcggatcagaagtttgagaatgtccctatcaagactgtagggctgagcagctcacaaaacattgaatttcttgatcctgaatcacaagcgatagatgtaacggctaaaggctctcccacgaatataaataaactgaaaaaatcagatattgaattgtatgtgaatgtttcagatttagaggacggggagcatagcgtgaagcttgaagtgaacgggccacagaatgtaacttggtccttggggcggaaaaccgccaaaatcaagctgacgtctaagaaaagcaatacatcaacgaatgataacagcagcaatacatcagggaaccaggatgacacagataaacaaacaaatgatcaaaagaacaatcagcaagaagatacaaagaacactgataaaaacaacaacgatcaaaaccaagacgaaaataaagatcaaaaccaagatcaggatgaggatgaatccactgcgaattcacaatcctcatcggaataaaaaaggagcgattataaaatgggcaagtattttggaacagacggtgtaagaggtgtcgccaatagtgagcttacacctgagctggcctttaaagtcggacgtttcggcggttatgtgctgacaaaagacaaacaacgtccaaaagtgctgataggccgcgatacacgcatctccggccatatgctggagggagcccttgtcgccggacttttatccattggcgcagaagtcatgcgcctaggtgtcatttctacaccaggtgtatcttatttgacaaaagcgatggatgcagaggcgggcgtcatgatttccgcttctcataacccagtgcaggataacggcatcaaattctttgggggagatggatttaagctttctgatgaacaggaggctgaaattgagcgcctgatggacgaacctgaggataagctgccaagacctgtcggagcagaccttggacttgtaaacgattattttgaaggcggacaaaaatatctgcaattcttaaaacagacagctgatgaagatttcacaggcattcatgtggcattggactgtgcccatggcgcaacgtcatccttggcgacacacctgtttgctgatttagatgcagatgtttctacaatggggacttccccgaacggattaaacattaatgacggcgtcggttcgactcatcccgaagcgctcagcgcgtttgtcaaagagaaaaacgcggatctcggtcttgcgttcgacggtgacggcgaccgcctgattgctgtcgatgaaaaaggaaatattgtagacggcgaccaaatcatgtacatatgctcaaaacatctgaaatcagagggccgtttaaaggatgatacagtggtttcaaccgtgatgagcaacctcggcttctataaggcgctcgaaaaagaaggcatcaaaagcgtgcagacagctgtcggcgaccgctacgtagtagaagcaatgaaaaaagacggctacaacgtcggcggagagcagtcaggacatcttattttccttgattacaacacgacaggggacggtttattgtctgctattatgctgatgaacactttgaaagcaacaggcaagccgctgtcagagcttgcagctgaaatgcagaagttcccgcagctgttagtcaatgtgagagtgactgataaatataaagttgaagaaaatgaaaaagtaaaagcagttatttctgaagttgaaaaagaaatgaacggcgacggccggattttggtgcgcccttcaggaactgaaccgctcgtccgtgtcatggctgaagcgaagacgaaagagctgtgcgatgagtatgtcaatcgcattgttgaagtcgtccggtcagaaatgggattagagtaacgaagtctattatcagagagtgaacaagacaagcgaggattacataagataattgtgagacatacggcaaagttgtttaaaaaacaattgaccgtttatgccacatgttgtaaaatcaagcttgtcttgttcttattttctcaataggaaaagaagacgggattattgctttacctataattatagcgcccgaactaagcgcccggaaaaaggcttagttgacgaggatggaggttatcgaattttcggcggatgcctcccggctgagtgtgcagatcacagccgtaaggatttcttcaaaccaagggggtgactccttgaacaaagagaaatcacatgatcttccaaaaaacatgtaggaggggacgattgaaagtccccttgaaatttgactttcttcgtctccttttacaatcttaggaggaagaaaaatatgtgtggaatcgtaggttatatcggtcagcttgatgcgaaggaaattttattaaaagggttagagaagcttgagtatcgcggttatgactctgctggtattgctgttgccaacgaacagggaatccatgtgttcaaagaaaaaggacgcattgcagatcttcgtgaagttgtggatgccaatgtagaagcgaaagccggaattgggcatactcgctgggcgacacacggcgaaccaagctatctgaacgctcacccgcatcaaagcgcactgggccgctttacacttgttcacaacggcgtgatcgagaactatgttcagctgaagcaagagtatttgcaagatgtagagctcaaaagtgacaccgatacagaagtagtcgttcaagtaatcgagcaattcgtcaatggaggacttgagacagaagaagcgttccgcaaaacacttacactgttaaaaggctcttatgcaattgctttattcgataacgacaacagagaaacgatttttgtagcgaaaaacaaaagccctctattagtaggtcttggagatacattcaacgtcgtagcatctgatgcgatggcgatgcttcaagtaaccaacgaatacgtagagctgatggataaagaaatggttatcgtcactgatgaccaagttgtcatcaaaaaccttgatggtgacgtgattacacgtgcgtcttatattgctgagcttgatgccagtgatatcgaaaaaggcacgtaccctcactacatgttgaaagaaacggatgagcagcctgttgttatgcgcaaaatcatccaaacgtatcaagatgaaaacggcaagctgtctgtgcctggcgatatcgctgccgctgtagcggaagcggaccgcatctatatcattggctgcggaacaagctaccatgcaggacttgtcggtaaacaatatattgaaatgtgggcaaacgtgccggttgaagtgcatgtagcgagtgaattctcctacaacatgccgcttctgtctaagaaaccgctcttcattttcctttctcaaagcggagaaacagcagacagccgcgcggttctcgttcaagtcaaagcactcggacacaaagccctgacaatcacaaacgtacctggatcaacgctttctcgtgaagctgactatacattgctgcttcatgcaggccctgagatcgctgttgcgtcaacgaaagcatacactgcacaaatcgcagttcttgcggttcttgcttctgtggctgctgacaaaaacggcatcgatatcggatttgacctcgtcaaagaactcggtatcgctgcaaacgcaatggaagctctatgcgaccagaaagacgaaatggaaatgatcgcccgtgaatacctgactgtatccagaaacgctttcttcatcggacgcggccttgactacttcgtatgtgtcgaaggcgcactgaagctgaaagagatttcttacatccaggcagaaggttttgccggcggtgagctaaagcacggaacgattgccttgatcgaacaaggaacaccagtattcgcactggcaactcaagagcatgtaaacctaagcatccgcggaaacgtcaaagaagttgccgctcgcggagcaaacacatgcatcatctcactgaaaggcctagacgatgcggatgacagattcgtactgccggaagtaaacccagcgcttgctccgttggtatctgttgttccattgcagctgatcgcttactatgctgcactgcatcgcggctgtgatgttgataaaccgcgtaaccttgcgaagagtgttactgtggagtaataaatgtttaacccctttggataagattgtctaaaggggtgtttttatgtccaaaagagaaagaacgtctacagtggaaaaatggattaaagaaggtgatggtacaggactcgactatctatcggccatggctatagatttaagatgtttccacattaggtcggttaacgaggttaaaagtcattaagacttggagagaaactgcttttgcctaactgagttttctgatgttaatacagatataagagagcagttcctcattaagatacgcttttgatagcagttggaatttagcatgctagaaatccgaaaatcgaagagcctattggaatgataacgtgtttttttattgtcaattaataaaggcaaaagaattctagaagtcgcacttacaatgtacttgtgagattaggttttaaagttcatcctttttttattgagtacattccggtttaagttgaaatgattcagtaaaggacacgccataaataaaaggtagcgtatgactcccattttttccatgaaaacgatatttctaagatttcatctttcgtaggctttcgattcatattacgtaatatttttatcgaacgaattagacacacatcatcgattggaaaagctgtcgggaacctaaggcagcgcattagaacataattggctgtccaaggaccgattcctcgtattttaattaagtttttttcagcatctttaaagttcattttcattaatttttccctcgataattctccacttgccattaatctggctattccaatgatatattcacttttttttaccgtcattttaatatctgccaggtcggtaggggttaaccgtgcaattcgttcgtacggtgggaacacccaatactttttaccattccattcaatagaatcgccaaatgcttctacaaattgcttctttaaggagtacgcgaaggctaagttaatttgttgccctaaaactccccaacataaagcttcaaataaatcgggaatgccgatcactcgcaacccataaaattttcgggcaggcattttaagtaatggatctgcttttgccatttcataaaatggagttaaatcgttatcaagatcaaaccattcatgaatatattttacaatctcttcccgtttccactgctcaacaggtctagaatcgtttaggaattgaacaatcatttgtttattattgattacgcttacctgcactaaggaccgaatttccccaatggctataacttttgtaatgatattgttttctatttcatacatgcattcatttttttccctggttaggtagcctaggttcgcattcatgtcgaatgtttcaggtaatgtaatgacgataacatcattgacttcatgccatgtcactttttcattctccttatcttaaataattataagaaaactcacgctggttgaaattagtttatcacataatcatctttactcattttgttatcttgctattacattctaaccaccttatttttttctatttatgaggttatagtgtagttatcaagaatgctaaacgggagtagataaaaatggcccaagatataaaaaacgcgtgtcgaaaatttaaattgggattcaattcaaactgaattagatgagcattgtaaggagaggtgagataaatgccggatagtatcaataacggacataaagagagccatgagcatagaatttcgaatgatgcagaaatgataacagatgaaaagtggcaagccattataaataatgatgcagcgtacaataatcaatttttctacgctgtaaaatcgacagggatattctgtaaaccatcctgtaaatctcgcgttccgaaaaaagaaaatgtatgcatttttccaaacgcagaacaagctctccgcgcaaattttcgcccttgtaaacgttgcaagcccactaatgaaaaaatgcctgatagcgagtgggttgatttaattactgaatacattgataaaaatttcacagaaaaattaacgctagaatcgttagcagatatttgtcatgggagtccgtatcatatgcatcgaacatttaaaaagattaaaggcattacgctggttgagtatatacaacaagttagagtacacgcggctaaaaagtatttgattcagacaaataaatcgattggagatatcgctatatgtgtgggtatagctaacgcgccttattttattactttatttaaaaagaaaactggacagacaccagcacaatttcgtcaaatgagtaaaatggaggaaacgtacaatggaaacaaataaaccaaccctttattggtctttactaatgttcaagaattggaatttttatattgcttcaactttaaaggggcttgtgtttgtaggttcacagaacaaaccaatcgaggaattgttcgaatgggctaggaaacgctttccgggaagtcttcttgttgaagatgatgataagcttgaaccctatgccgttgaaatcactcaatatctagaaggaaagcggaaaaactttactgttccagttgagtacgccggtacgcaatttcagctagccgtctggaatgcactttgtgaaattccttatggacagacgaaatcctattccgacattgcaaatgatataaataaaccagcagctgttcgtgctgtaggtgcggctattggggctaatccggtattaattactgtaccgtgccatcgtgtaataggaaagaatggctcattaactggctatcggggcggatttgaaatgaagacactgctcctcgatctggaaaagcgagcttcatctgaaatggatgttcctcattgaaagtgaatcatctataatgggttggattcttttagaggaaaataaagaccagtttactgataaacttgacaacttttaaaatttagcatatcttatacgtaacttaataatcgatgccgatgtttatttttccttttaaaatatgtaggcctttagcattcttttcatatttaattttaaatattgataggatgaaaaagcatcctaactaaaaaggaagagaaacataagtcgatttatttgataatcaggactatattaaaggaaatgaaaacatagcataaagtaaagaccaataataaggtagctcttcaaaaaacttcgctgaagttagttgaagtgaagccgacaattttcaggattcaatgatctaacataatcattgaaattttgaagttgtcggcttttttgttggaaaaaaatagagataaataaaaattgaaataaataatagacaaatatgatctgattgaaaggtcttttgaccaataatgagttttaaaaaagggagaatttagaatgttagtttcgctgagtttgtcatcattattaacattattttttattatgcttatggcttctgggattagtggactattgtttttacatccgcgagtacccttgagttttgttcgcattcatattgggatcttggctttaccacttttggtttccttactgattcttgccaatagtggtgtgagtggaaatgttggcccttggcacttagattccttagcttgtttaatgactttctttgttcttgcaattggattcatcattcagcgtttttctgtacgttacttaatgggggatcgatcttatcgaaaatattttacgctttttactatcacaacaggagctgcttcaatgacatggttaagtggtgatctccgcttgatggttctattttggggtgcgactcttgttggattaaccttacttattaggttaaacagtgcttggcaagtggctagtgaagcagccaaaatttctggccggttatttttgttaagttggttttctttgttttttgcgatgatatggatttttcatgccacaggtcaatggcagctatcattggttgtaacaaatgaaagtttagctgggctgggagaatgggggagaacagggattcagctattgattgtattagcagtgattattcctgcagctcaatggccgttccaaagatggttggttgagtctattgttgctccaacccctgtttctgcaattatgcatgcaggtttagtaaatgcgggaggaataatactaactcgattttcacctctatttcatggtggtatcgcttcgattatcttacttctgcttgctagcatttctgtattgattggaactggaattagtttagtccaggttgattataaacgccagttagtaggctccacgattggacaaatggggtttatgctcattcagtgtgcattaggcgcctatatagcagccattattcatcttattttacatggtttattcaaagctacgttgtttctacaagctggttcagcagtagggcgtcatgaagtatcggctcgcactaatgaaagaacatcctatttatgggtcatggctggtcggattttatccttagtaataggcgttgttttttggctcgctgctcctggagagggatatcaattcattagtgcgctgatcttagggtggtcattgtccgtttcttggaatcagcttgtcgcttttggagagggccgaattggccgaattgccggcttaactgttttaggaggagcagccctcgtatattttatcattcataaccttttctataagtggctgcatacaaccatttttcaaagtgttcaaccaccaatgtcagctgtcatgattgtcgtatgtctcttattatttggcagtgctttaggtacatgggttgctcgttatcgttcttccgtttttttcgcggtgctctatctttggttagttcgattaggtgaagcaaaaccaaagtcagtagagagtcacccagactaccttaaacaatatatttcataaggagctaatctgagatgggcattacatccgtattaacgaaagataatgtaaaaaagatagatacagatattgatgttcaagaaagggatcttaacgttttcattacatctgccagccgagtgattgcgccactttggcctatttctacatttgctgcacgtaatccgtggatgggacttgaaaaccaaccttttgatcaggttgcaagttggttgaaaaacactcgcgatgttgatatataccctagtgcgtctatgatccgttcagcaaagaataaaggtgagattgatgaagattttgtggaaatggggctgcagcgttggcttgattcacattcctatcacatcccacgggacgtggcagagcgattttgtcatgctgcattaaagttaaatcccctgccttccgaccttttatcatcacatgagctggagaaattagtaggtgaatgtagtggattggatcatatcgagaatgtgtttatgcagccactaagttcgcatatagagaatcaagatggtgaaaggctagtcaatatactagatcatcatgtcattaagtggagtaaattatatcttgatgactctcaagcaggctggacaatgcctaatcgtgaggaaggtttctatcgtgcttggcagcatcttattcaatatgatccagcacttagcaaaaagcagcgagaaagggtaaagggttggccgaaagaggcacatttggctttacagaaagctttattcgcactagaaatcccagagtcagaaatccagacttatcttgaaggtcatttactttcattacctggatgggcagggatgatgctttggcgctcccaacaatcgagccacgaacatgcactcctaacagaatatttagcggttcgaatatccatggagtgggctcttataaagccatatttacctttgactaatgaacgatctaagaaaacaatttcaattgctccccttatagcagcttggattcattggggggggcttacattagaagaatggtcacagatgacggccattgaacaaaacgaatatttatcatttgcctacagctttgatgaaaaacttcgcaagaaactttggttagaagcttgggaacaaacgtacactgatcgattaagccagaagattatctcgaaacaacgtgaaaccggccgtaaaaaatctgcattagctcaattagcattctgcatcgatgtacgatcagaaccttttcgtcgtcaactagaaaaagaaggcccgtttgaaacgattggtattgctggtttcttcggggtgccgattgcaacttgtgaacttggcagtaaacacagtcatgcttccttgccgatcatacaaaaaccgcaaaataaaataaaagagttcgcagatgaggatgtattcaaaaaatacaatcaacggaagcaagcaattcattctttaagccatacctttaaaacgatgaagcagaatgcgctttcgagcttactactgcctgagctaagcggaccttggcttactctgcaaatggcagcccgtagctttgtgccaagaaaggcgggtcgtttcattcgtaatctccgtgaggcttggttacgcaaacctgatacaaaactctcgcttcatcatgatgctacagaagcagaaatgcctgtgggttttactgatgaagaaaaagtgaactatgctcgccaagcattaaaaatgatggggttaacagaaaacatcgcacccttggtcgtgatctgcgggcatggcagtcaaagcactaataatccttattccgcagcccttgattgtggtgcctgcggtggagcggccggtggattcaatgctagagttttagctgctttatgtaatctatcagaggtacgagaagctcttttagctgaaggaattcaaattcctgaggatacggtttttgcagcagctgaacataatacaacagtggatgaattacattggctttatgtaccagagctttccgaagctgcacaagaagcatttgatcaaattgaagccgtgatgccgaaagtgagacatcatgtaaacaaagaacgtctagcccaattaccgaatttccaatcgaagctaaaaaatccgaaggctgaggcaaaccgatttgcggaagattggagtgagatacgtccggaatggggactggctcgtaatgccgcttttattatcggtaaacgtgaactaactcaggattgtgatttggaaggcagagcctttctccataattatgattggaagcaggatgaaagcggtgaactcctagcaaatattattgcaggacctggaactgtagcccaatggattaatttacaatattacgcatcaacggtagcacctcattattatggtagcggaaataaagcaactcaaaccgttactgcaggtctcggcgttatgcaggggaatgcaagcgatttgttagccggactgccttggcaatccgtcatggaatcagatcacgaggcctatcattctcctcttcgtttattgatactcatccaagcacctagagaatatgtagaacggttattaaataatgattcagcatttctgcaaaaagttcaaaatggatgggtccgactggctagtcttgatccagaaggatgttgggaaagctggtaatgatgaatctaagcatttatcaaatggatttgttactcaatacaaaaatgataaacataaggaagaggtgtgctgtatgaatgtaaaccaaaataaaaaagtattatttttgacggatattgaaaacggtttggagcctattttacaagaagcgactaacacttctgcagagaatatgttgactatacaaagctatggtgccggtatttcacatccttatggagaaatcatgaggtctgttatttttgcgatttaccaggaagatgttgaggagatttttgtagtaggaacaaaagataagaagacttccgcaggtaatggactaactcaacttgaaacaatgaaagataaaatacaaacattggattatctttttcaaaattgcaagcctgaatttttaggtggtacggtcgatgaatggctaaatgaaaatagcagtgacaccattgaaaaaagtgttgatatgattcgacatcatcccctagtgccgtcatatgttaaagttagaggtttattcgttcatcataaggatggaaaaccctcaatcgtggagggtcctgatgttaaaacaggtcaagccttacctgatcattgcttgtcatgatgaaatgcaggtttaacttctaaacgcacccatatatggagaaagcagttctaaggagattgtatgagcgctaatttaactgattttgtcacgaaaacaatagaggaaatgaactcgtttgatcgtgaaaatatggaatgtataaaaaaactaattagaaaagcaattgatttttatcatctaaagtcttatgaagaagttgaggaaacccattcaggaaatgttcgatttttgcatgtccactctatgatggaagaaaatatgttatccaaaatgatagtggtcacaagaaacggtaaaactgatttggatattgaaggtgtatatgaaggatatgttgtaagagaatattaatgagacgaaatcacaaatagaatatgccaatttttttgctcaggagatgtattagatatgaaaaagtctaagggttctattgaatcagagatcagtaagtccattactcaatgggagaaggattatcttgggcgggggtctgtatctgttaagactgatatactgcgggacatgatcatcgtcaatttaaaagggattttaacaccagccgaatatgtagtttgtggatcaaaagagggtatgttatctatcaaacaaactcgttcggagttagtcgaatcaggtatagaaggccttaaggatattatcttaaaaataaccggagaaaaagtgaaaagttttcatactgatttaagctcccggacaggtgaacgagtgatggtatttaaattatgtaatgatctagagaaaaatttggaaaagatcttataatctaaagaaaataaatgttaagacggtatggaatttgttgtgaattgaacataaagaactgccgattcttttgttttacaattatggtatcattgataacttttattcatatcctaagcggacataaagagatgtcaattcatagtacactgttgtgttattcctgtcgaaagatctaacatccgctgttgttatgagcggatgtttttttacatctattttaaatacatgaatttgatgctggtgattagtcacttgaacaatatttgaaaacatccttgtcacctgccgggttcccccaagtgtttagtgacatgattatgagaccaatttcgtaaagcttgatgataaatttaagcggtgaacaaaattgatatgctgtcttcagtttcatttcacggaattagtcagagataaacctttaattaaaaatatccaaaaaaacggattgacatatcggaatataacgatataataatcgatatggaaccaattgaagtattcaaagccttatcaaatgaatcaaggctgcaaattttacaatggctgaaggagcccgatcgtcattttgcaccccatgaagggattgatatgaacacaatcggggtatgtgtcagtcaaataacagacaaattgaaaatgacgcaatcgacagcttctcaatatcttaccatccttttaagagccggcttgattaaggcggagcgtattggaaagtacacatattacaaaagagatgaagaagccattgggaaacttgctgactttcttaaaacagagatataaaaataaacatcaaaagatgtttatttttacaccatacatatcgacatattacgatgtgtttattttttataataacatatcgataattcgtgatatgtttattaataattaaggagtgaatgttttatgtctaacacttggaaaatttatattttagccattgtcagctttttagttggaacctcagagtacatcatttccggaattttggatcaaattgctcatactctcgggatcactttagctgccgcgggccagcttattaccattttctcacttgtatatgctctttctacacccgtacttatggcgttgacagcaagtatggatagacgcaaattgatgatgtatgccctatgtttgtttgtgttcggtaatgtcctggcttttgtactgcctggttatggatggtttattgcagcgcggatcattatggcgatgggagcaggtgtggtggttgtcaccgccttaacgattgccgctaaaattgcatcggaagggaagcagggaagtgccatcgctacggtcgtgatgggatttaccgcttctttaatcattggtgttccgcttggaagaatgatagcagtagcattaggctggaagtctgtatttggagcaattgctttgttgggattgatcgcaatggtcgttattttctttactcttccgcatactgaaggggataagcctgtgcctttgcttcaacagcttgctcttttcaaaaaacggaaagtggctatgggattatcaatcactttcttctggctcgggggatattctgttgcttacacttatttgtcaccgtatctcttgaacatctcaggtataaatggcaagctgctcagcggtgttttgcttatatttggaattgccagtttggttggatcaaagtttgggggatatagcaccgataaatggggagtgccctttacactcgttggcgggatgacgttgcatatcgtcacactgattcttctgtcacttgttactcattcctatatcggagtgttggtgattcttatattatggtcgtttgccgcatggtctacaggtccgacacagcaatttcacctggctaccatagaaccggaaatgtcaggtgttttgcttagcatgaatcagtcaatgatgcaattcgccatggcggtcggcgcaggtataggaggggtttttgtggaaaacgtatcattggcctcgattacctgggttggtgcgttaggggttatgattgccattattgcatcattgctgattttcaattcgcaaccgaaacaagcgctaaaagatatcaatcaataatttcgaaagttctaacatccgctcgttatacaagcgggtgtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttctttctcctataaaatttatataatagggagaaagaaatggggtgaacatcatatgtttaaaaaaatcatcaaaacgattaagtacctctcaagcagttctagtgaccgatatcgcagacaccggcattacagcagcagccggcgcagacattatcgcagctacagcagcagctcgggcaaaagaagacactacgaccgttatggcggcagtcatcgttacaaacgccggagctacagcagcagttaatccaaaaaagttcttgttccgcttttgggacaagggtttttttatgtgaccgattgaatggcccggtttagatcctcgcgaatggaagcggtgtgctgatactcttcctcaatgcccaataatcttttcagcagcaaggttacttcctttgtcagtgttaattcctccagccaagtgccgtttttcttcttttttcctttatattgagagtacagcaggaataacagcgtttctccgagatcgaagaagtcatcctgttttcgtgcctttatttcctccatttcttcaagagtcaattgtttggcaaggccaaaatcgatgaggcagagcctgccgtcattgatgatgatattaggcgttctgatgtcgctgtgaaagataaggcgatcatgcaggtattctataatctcaagcagctgcgaaatcagttgtaacgccataagctctgtgaacagctgttttcgaaaaaataataattcttctatattctctccctcgatgaactgcatgacataataagcctgtccgtctatgatgaactcatctatgaagcccggaatttgcgggtggtgaatgctattgagcagttttatttcctgttggaatcggactttctctttttcctttttcgcttttgtcggccgaagctgctttaagacataaggtgtttgagttaggatatcggtgcacaaataaaccaaaccgtagcctcccataccgaggcactcttcgattttgtattgatgatttaagataacgccgttctttagagggcggtcaaatagcagtttttttagaagctttaatgccatgtctgcacttcccttggttgtactgactatagtttaccttctagactgagaataaaaaagagccggataaccggctcggtataagttaaaactgctttgtcacgtcgtattcataatctatttttgtttttacgttgctcatcgtcgatctggctgtcgctaatgtattatatttaaaactccatacctttgccacactgagttgatctgacaaagagatatcataagaccctgaagtcgagctgtttacaagagcacggcgccattcgttgttttcgctcgtcatgatcaggtggcgtgtatttccctggcttggtgtttgagtggcggttgtctgaactctggttacaatggcatcacgcggtatcccagattggtttgttaaatcaaccttgatcacgctggagtcagaacctgaggggctaaggcttgtatttcctttattttcagcaacgccgctgaattggaacgttccgctgcctgatttgattcggtcttcaattgaaagcgtaaagtacatgtttccagtataggtgcctcgtgacactttcacataaaaggtatctgtcgtgttttgggcgtctgcatttgcataaataaaagaagaaaacgtattagggttaatgacttctgtcccttgagaaacaggtattctattcttatcataaatttcaattttcatccctgtatacgcgctctggtatgtactcctcacgtatactttttctcccttattagccgtaaaagtgaaataggcttcatcttgaccagcttccagtattgttgtatcgatatttttatatttccaataaccgatcggcattgcggtatcaaatgaattgtttcctgtgatagcagtgactccaacagctgatgccgaatacgtaaaggtgaataagacagacagcataacagcgaatggaataagccattttttcaccatgcaaacaacctccttttatttccatcatacataataacgatttaggtgtaaataaatgttttttgaggttaatatatacattatctttgccgataaaaaagaataagagagaatactcgggagggaattcaatgcgtctgaatcggcaatttatccgcactcagctgatggcacagaacatattgagcaagaatgcgcctgccaaacgggagaatgcgactgaaaatccagcggcagttctggaaaaggcatacagcaggcttaagtcacaatcttcaactgggggaatcaatcagttcaattattctaaaaccagcgtgtcgggaaacagcgggacgttcagcaaagtgtatcaatcagcgaatgatcgaacagtgacagacacaggggaagaaacagtgattcaatcccaaaacccctatgaatctgagagtgatatcagaatcaaaatactagatgaaaaatacagcaggatgaatgcgattaataaaacaaagtctgatccattaagctatattaaggataagtaccaaaattcaaagtctccttatttcagaagtgatctgtcagctgcagaaagacaggccgcttacgataatgaaacagaatggttattcaaagggaaggcgcaaaactataaccttcaggatgctgtgtttcggaatgtcacatttcatggggaagtggaagctgagaatgaaaaggtgtatcagcggggacaggttaaccagcagctgcaagtgctgttgaatcgaaaccatattcatattccagaggggacagagctgacgtttacaatcacaccgattgactatcaggtgcgggtaagcgggacagacgatcaggatctgatcaagcaaattgagcaagtgctgcaatctggagacaacagcaaagaactatttttgcacatcatgaaaagccaaagcagtgattcagcacaattttccgaagaggcctaccaaaagtatcaggcagctcgtgagatgtatgaagttacaggctaccatttgaaggatttagaagtgattgatgggcggtacgtcacgcctgagggacgtgacttaatggatgtatataaggaagagcttgaaaaagatccagtgcagaaacaaacggcttcttatgctatatcttactatcgttcagagctcagtaaaatcgcggaagccgggtataatgccattccggatttcatcctatcaattgattacagcaatggatctctgagagatgtgggacaaagcaagagctatgggaccggagataccgggtggcttgaagcattaaagcgtcaaacgggtgtgaattattaggtaagctgttcatgtagaacagcttattttttatgagaatctaaggggtgtattaatttcaatattcaaataattttattttttttatataaaagattttaaaagaagtgaacgattcaaaactctgaacaaaggtgtttacctgaaaaaaacaattgtatttttcagagaaatttattatgatgaaataagtaatttaggagattatataacaattttaagtttgaattttctgattgttatcgctgattcatgtgaaggcaagcaggtctgctgttttctcatttatgttaggaggaggaagaggagtggcaaataaagaattaaagaggggcctgggcgcgcgccatattcagatgatcgccttgggcggtacaatcggtgttggcttgtttatgggttctgccagcacgatttcatggactggcccatctgtccttctggcttatgcaatatgcggaatttttatcttttttattatgcgtgcgatgggtgaaatgctgtatgtcgagccgagcacaggctcttttgcgacgttcggccatcaatatattcatccgatggcaggttatataacagcatggagcaactggttccagtggattatcgtcggcatgtcagaaattatcgctgtcggttcttatatgaagtattggttcccggatttgcctgcttggatacctggtatcgtggcaatggtgattcttggtgcggcgaatttaatttctgttaagtcgtttggggaatttgagttttggtttgcgatgattaaaatcgtgacgattatcttgatgattattgcgggaatcggaattattttcttcggttttggcaatggcggagatgcgatcggtttgtcaaacctgtggtctcacgggggcttctttgcaggaggtttctcgggtttcttctttgcactgtctcttgtcattgcggcctatcaaggagttgagctgatcgggattacagcgggtgaagcaaaggatccgcaaaacacgctaagaaatgcgattcaaagtattatctggcgtattttgattttctacattggcgctatttttgtgatcgtgacggtgtatccttgggatgagctcaactcactcggaagtccgtttgtgtctacgttctcgaaaatcgggattacggcagcggccggcattattaactttgtcgtgattactgcggcaatgtccggctgtaacagcggtattttcagcgcgggccgcatgctgtatacactgggtgtcaatggacaagcaccgaaattctttaagaagatttcacgcaatggtgtgccgctgtatggcacaattgcggtgctgatcggtttggctgtcggcgttgtactgaactatatcgcgccgccgaagatctttgtctatgtatacagcgcaagcgtgctcccagggatgattccttggtttatcattttgatcagccatatcggattcagaaaagcgaagggtgctgcattagataaacatccattcaaaatgccgtttgctccttttacaaactatttgacgattgctttcttgctgatggttctggttggcatgtggtttaacgatgatactcgtatctccctgattgtaggcgtgattttcttagcgcttgtggtcattagttattatgtgtttgggattggcaaacgcacgcaggccaatttgacaaaaagcgaacaagcagctgaataacgataaaaaagagacattcacggatgtctctttttttatttttcgcgtatggattttccctattttagcaagctatagggtaaagatagcagaaggaaaggtgttcataaaatggatgttacactcggttatttgcgcgaatcactttcgaatcatctagaaaatgaagtctgccagcgtatttgcaagaagatgctggcgaagcgttatgcaaatgaaggggaatttgtaaaagacttagatgataatgaaatgtcttttttgaaccatgtattagaaaaagaaattaagtatgcccagaatgaacaggatcaaaaacgggccaaggaattaaacgaggtgtatgaattactgctttgagaaaggcgggtaagaaatgggagcaattgaacgaagcggatatacatttcagccggagtttagcgttgtccgtcaaaacggagccatccatgtgtaccatcaaggagaatttgtggaagaaatcgaatttgaatttaacggggaatatcccgatcatgatttgattgaagagcttgtgaatcattattgttttgagcatgagatttagagccctgccgtgcagggctcttttatttaggatgtgatcaggccatactttttcaggatatccacggtgatgtttttggcttttgtgccggaatcatcgacattggtgacaaagacataagagccatgctctgttttgatgaatccgacaaaccatcctaatcccatatcagtcaggcgggttccggttttcccgtagagcgagtaatgatcgccttcctcttgaatcatcatgcgcttgacggttttcatcaccggcttgtcaaatggaagctcctctttagccagtttctccaaaaaagtttcttgttccagcggagatattgtgagcgagctttgcagccaaaactggtcgattcccccgctgatatcctcgttgccgtaagatagagtatgaagccatgttttcattctttcctcaccgatatcccgcgctaatgcctgataataccagattgcggattcgcgcatggccgagccaagcgtatggtcgcggttccatgattcgaattcacgcttgaccccgtcccatcgtttaacatcgtattcatctcttacagctttgacctgcaagccgattaaagcgttcacgactttaaaggtggattgcggagtttgtctttgatttgcccgttttctgttatagacaaatgtctgatccttttgttaatcgtgaagaatgaaggttccatccgtatccttgaattcgtcatcgacattcattctgctgacattcaagtgtttttcatgagcagatgatgctgcgtggacggagaagccgccgatccctgcaatactcagcacaagcacaatatatatccattttttcattttgttctcccctttgttttgattaactaccttttctctctttcgtttgttcttcctttaaaaaataatcaaaaagcgcttaaatttggttttgtaaacaaatactgttactgggtttatagtcggaagataacgtgaaaatagagggtaaaaaggaaggcagggtaagcggatgaatgagcagattccacatgacaaaagtctcgataacagtctgacactgctgaaggaagggtatttatttattaaaaacagaacagagcgctacaattcagatctgtttcaggcccgtttgttgggaaaaaactttatttgcatgactggcgctgaggcggcgaaggtgttttatgatacggatcgattccagcggcagaacgctttgcctaagcgggtgcagaaatcgctgtttggtgttaatgcgattcagggaatggatggcagcgcgcatatccatcggaagatgctttttctatcattaatgacaccgccgcatcaaaaacgtttggctgagttgatgacagaggagtggagagcagcagtcacaagatgggagaaggcagatgaggttgtgttatttgaagaagcaaaagaaatcctgtgccgggtagcgtgctattgggcaggtgttccgttgaaggaaacggaagtcaaagagagagcggatgacttcattgatatggtcgacgcgttcggtgctgtgggaccgcggcattggaagggaagaagagcaaggccgcgtgcggaagagtggattgaagtcatgattgaagatgctcgtgccggcttgctgaaaacgactcccggaacagcgctgcatgaaatggcttttcacacacaagaagatggaagccagctggattcccgcatggcagccattgagctgattaatgtattgcggcctattgtcgccatttcttactttctggtgttttcagctttggcgcttcatgagcatccgaagtataaggaatggctgcggtctggaaacagccgggaaagagaaatgtttgtgcaggaggtccgcagatattatccgttcggcccgtttttaggggcgcttgtcaaaaaagattttgtatggaataactgtgagtttaaaaagggcacatcggtgctgcttgatttatatggaacgaaccacgaccctcgtctatgggatcatcccgatgaattccggccggaacgatttgcggagcgggaagaaaatccgtttgatatgattcctcaaggcggggggcacgccgagaaaggccaccgctgtccaggggaaggcattacaattgaagtcatgaaagcgagcctggatttcctcgtccatcagattgaatacgatgttccggaacaatcactgcattacagtctcgccagaatgccgtcattgcctgaaagcggcttcgtaatgagcggaatcagacgaaaaagttaaattaaaaagctctcttcctttatcgaagagagctttttgattacttctttttttcatcgtagtattggacgggatacatggagccttctgataccattttgttgtcctcgatatcttgcgggtccgggtggccggctttatcaactgggaacgtttccatgtctggctgttttgttattttcatcttcatgctgtgaatgaattctcttgccttttggcgatttgacgggtcttttaatagataagaagtgatgccgacagttgaaacagcgagacctgaaagtaacagcttttgtttcatggtgatactcctttctattttaagaatagtgtttcctgtatcattcccgttttggaaattgctaaacctgttgtgtttttatcattggaattaacagtaaattccatttaagaagaaactagtgacttcattcctgtattggaaggtaatatacattgacttattatcgtttcagtcaaaattcgataaatattgacaaagtaaagtaatcagaataataatataattagcaagagaatgtcatcatacatgaaaggtgtttacgatatgaatcaattgcatcgaagaatgggaacgttttccctcatgatggtcgggctcgggtcgatgatcggttcaggctggctgtttggggcttggcgtgcggctcaaatagcaggaccagctgctattatttcatgggttattggaatggtcgtcattttatttattgctctttcttatagtgaactaggttctatgttccctgaagcggggggaatggtaaaatatacgcaatattcacacggttcgtttatcggttttattgcgggctgggccaactggattgcgattgtgtccgtcattccggttgaagcggtggcctccgttcaatatatgagttcttggccttgggaatgggcgaaatggacaagcggtttggtgaagaatggaacgctgactggggaaggactagcatttgcctctgtattgcttctcatttattttctgctgaactactggacagtcaatctattttcgaaagcgaattcattaattacgatttttaaaattattattccgggtcttacgattggagctttgctgtttgtcggattccacggagaaaactttactggcggtcaaagcattgcgccgaatggctgggcaagtgtgctgacggcggttgccacttctggtatcgtttttgcgtttaacggtttccaaagcccgattaatatggcgggtgaagcaaaaaatccggggaaatcaattccgattgcggttgtcggctctcttttcgttgcgacagtgatttatgtcctgctgcagatcgccttcatcggagcggtgaatccttctgatattgctcacggctggagccatttgaattttaattctccttttgctgatctggcgattgcgctgaatattaactggctagttattgtgttatatgcggatgcatttgtatcaccgtctggaacagggattacgtatacggcgacaacgtcccgaatgatttacggaatggaaaaaaacaaatacatgccgagtatattcgggaagcttcatccgatttacggcgttccgcgacaagcaatgttctttaacttgattgtgtcgttcatctttttgttcctgttcagagggtggggcgtattagcggaaattatttccgttgctacgttaatttcttatatcaccggcccgatcacagttatgacattgagacggacggggaaagacctgtacaggcctcttcgtttaaaaggcttaaacgtgattgcgccgcttggatttatcttcgcgtcactggtgctgtattgggcgcgctggccgttaacagggcaggtcctgtttattatcctgatcggtcttccgatttatttctattatcaggcgaaggcgaaatggaaagggtttggccgaaacttcaaagccggcgtttggatggtgttttatctgctggccatgatggtcatttcttatttgggcagtgataaattcggcggcctgaatgtcattcattatggctgggatatggttctgattgcgatggtatcacttgtattctatgtgtgggcgctgaagagcggctaccagacagaatacttaaaggatgcgaaagagataaattctcagctgcttaatggacagtcagaagctgctgccggaaaagaataaaataaataagaaaaccttgcgatagttgtcgcaaggttttttgcttttaataacccttttttactttgtggaaaagatcaggatagttggtgaacactcctgttacgccccaatcaagcaggcgatgcatatcagcttcattattgactgtgtaagggtgaagcaggaggccgtggctgcggatcatacggacgttttcttgatttaaagctttataatccgggcccgcaccgacagcgtatgttttgatttcttccagggcagcatctgtcattgacgccatttgtttggcttccagcaattgaacggtcggcaggtttggctgtaattgatggacttttaccaggctttctttgctgaacgattgaatgatcacctggcctggcttagaatgcttccctagtaatttatgtttctgcaaagaagcgatcagtttttcttccatacctgggtaggtgtcaggcgattttgtttcaatgtagtagttcgcgtgctttccgaaacggtctaatacctcttctaatgtaggaactttaaggctgacgtactgcggctttgctttttccggataggcttcattaaaccaagaaccggcgtcaagcttcttaatgtctgcgagcgtatggtctttcacccagcccgttccgtttgtggtgcggtccagtttttcgtcatgcatgacaatcaatttcccgtcttttgtcatttgcagatccaattcaatataatcagccttcattttctgagcggtttcgtaagacagaatcgtgtgctcaggcacatatccagaagcccctctgtgcgcgacggtcaggatacggtcaggtgacagcaggtttccttttgacgctgccgacactggcgttaccataaatgagagtaagcccagcgacagaacaaacaaggccagtattctattttttctcatgatttctcctccttatagataagcactacctgtctttcatattaaaaaacggatgtaaacggcgtgttggaaaatgattaatcttttatgtgtctttcttaaacatgctctgcccgttttcctgtattccacgtcaaagccaagaagacgatggcaagaatgcaggatgagatcagcatgataaagccgccgttccagttaaaacggtccacgacaaagcccataatggcgtttgcgaaggcggatccgccgatgtatccgaaaaatccggtcaaaccggctgcagttccggctgcttttttcggtgctagatcgatcgcttgcaggccgatcagcataacaggtccgtagattaagaagccaatgctgatcagggcgatattgtccacgagcggattgccggccggattcagccagtacaccaatacggcaatgaaaacacccgccataaacaaaacgcctgccggtgcccggcggcttttgaagaatcggtcactgatccagccgcacaagatcgttcccggtatgcctgcgtattcgtaaagaaaatacgaccagcgtgagtcttcaggagaaaagcctttggcttctgttaagtaagtaggcgcccagtcaaccacgccgtatcgcacgaaataaacaaatacattggcaaaagcgatgtaccaaagaaatttgttgttcagcacatattgaaaaagaatttcttttgttgttaattctttttcctgatttttaaaagcgtgttttggatagtcattccgatactcttcaattggcgggagtccgcaggattgaggcgtatcacgaaccaataaaacaattaaaaatgaaatgataatggcgatgatggcagggaagaaaaacacgcttttccaagtgacgaacatcgcgatcccaagagtgacaagcggagcaagaataccgccgcctatgttatgggcgacattccagatcgacatttttgtgccgcgttcacttatggagaaccaatgggccatcgtcctgccgcatggcggccagcccattccttgaaaccatccattgataaacataaaaataaacatgatggtgacgctcgaagtcacccaaggcattgaaacgaatagaatattaacgattgctgataaaaataggcctgtcgccagaaaatatctcggattacagcggtcagacaccattcccatgatgaatttgctgaagccgtacgcaatggacacagcggccagcaccaaacccagttctgttttcgaaaatccctgttcctgcagataaggaatggcaaaggcaaagtttttccgcagcaggtagtagcctgcgtagccaatgaaaataccaatgaatacttgcagcctgagccgtttgtatgccgcatccatctttgaatcatccagtctctcaatatgaggagccggtttaaatatattaagcattaataattatccccctttgctgtttgtgctggatgtgtggcgtgcctcctttcccgaaaaacaaaaagagccagaaaacaccccttgtcaaaaggggttggattcctggctctcctcatctccatccaagctattaacttatcatgatagcgctttcttaaattatcatagtccggagcgaatgtaaacgggtaattttcaaattgggccttagggaagtaaatattatccttttactaaatgcaattatatttttttactagtaacataaaaatctggagggaggctgtttaaaggtggatgaattagatatcgcattctttattttaccgttaggaattatgctgctatcgattatcgggacctgtatttgtaaaaacccgtatctgatgccaatgcttagtttggtgatttctcttgtgctcacctttaccatttttaatcaatcatttttgggatgggctgttgtctatagcttggtttctctggctttatcctatatcacattgattgtggtaaggaaaaggaaggaatcaggaaattaaaaagacctcactttctaatatatcgttgactaaagcaactatatgtgattataattgccttagtcaacgatattagaaagtggggattgatttgaaaacaagagaatcatctgtcggattaaaattcagaaagttcaatcgattttatacaaacgtccttggtttccttaatgagcacatttacgacagcccgttttccttaacagaaacacggattttatttgagatttataatacgcctaattgtacggcaaaagctcttcaggataagctggggcttgaccggggatatgtcagcaggattgtgaagcagtttgaaaaagaagatttgatctataaacagaggagcaaagatgacgcccgccaacattatatttttgtcacagaaacaggaaaaacgatttataaaaagctggaggagaaagccaacgaacaagtagaactgatgctgaaggaaatcaaccaaaaggagcagcacaagcttgccgaggcgatggcagagattgaagcgatcctttcacagtcgctttctgccagagcatcagagatatcgataagagattattttctttcggaggatcttcaactccttattgagaaacaaagacaattttacgcggaggctcacggttgggatgacacgtttttagcttatcttcaggagacatttgacgctgacatcgaaaaaatatggattgcggaaagcggcgggaaatttgccggctctgtcgggttggtcaagcacgatgaaaagacagtccagctcagatggtttctggttgatgcggattttcggggcagggggctcggcacgcaattgctggagcatctggttgcatactgccaagacatgaagtttgaccgcattttcctttggacggtgagcaccatggctgaggctcgtccgctctatgaaaaatttggattcaggataagtgaagtaaaacaagaagcgccattatggggacagcagctgacagaagaacggtgggatttggagctgtcatgaaaagactgcattatgcgtggatcatcgtctccgtcacctttttgatcttattggcggttcagggggtgcggctgtcgtttggtgcgtttgtggagccgtgggaacggcaattttcaatggatagaagcaccatctcgctgatttcgacgatgagttttattgtttatggcatatcacagcctgtgatcggtcggcttgtggacaaatggggtgcccgggctgttttggcatggagtgcgttactgacaggagtcagcattttcttaacataccttgtgacttcgccttggcagctgtttttgctttatgggctgggtgtctcgcttggagtgggaggagcgtcgaatgtggcggcaagtgtattggtcgtcaattggttcagcaaaaagcggggactagcctttgggatcatggaagcaggctttggcgcggggcaaatgcttctcgttcccggctcactcatgttgatccattggtttagctggaagctgacggttgtggtgttgggactgctgttaatcgtgattgtctttccggctgcgctgctgatgcttcggaacaatccttcagaaaagaatacagagccgataggcggactggctgcatcagaaaaagaaacagcacccaaaacaacagctctttcagtggccgggatgtttcgtatgaggcaattctggttcttgatttttccgtttttgatctgtggatttacgaccgtggggctgatggatacccatttgattccgttttctcatgatcatggcttttcaacgacagtcacgagtgctgctgtcagtctgctggcaggctttaatattgctggcatcttgctgtccggaattgtagcggaccggtggagcagccggaaaatcctgtgctttttatatgcggtgcgggcgctgtcgatcgtgattcttatttacagccacgagccctacttgcttttagcctttgcgattctgtttggattagtggactttgcaacggtagcaccgactcaaatgctcgccacccagtactttcaaaactactcgatcggcctcatgattggctggctgtcactcgcccatcagatcggatcggcactaggtgcgtatgtgcccggcgtcatctatacggtaacgggtgagtatacactggctttttatttgtcgattggaatgctcgtgcttgcgagcgtaatgaatatgatgctgagggagccagctgcggttacgcgtgacagtgcggctgtggtagagaagtgatgagagcagaggataagcatctctgatttgggattattcagagatgctttttttgtatttttgttctaatacgaagtcgatcataccgactatgcgggcgttttcggaattttatttgaagcgttctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagcatccattttacatccattctccaacagcttcgatttcggtttcatctccgagatgtagaggcctaaaagcgtaagggcgcctcctagaagagcgatccatgtcatgttttcatgcaggatcaggacggaggcggcgattgtgataaccgggaccatgtatatatacgcactggatttgacggctccgagcacgccaactgaataattccaagtggcgaagcacagggcagaagcgccaatccctaagaaaagcatgttgagtatatttgaagcagatgaaaatcggcttaggtcaaaatggaagtcgaacaaaaataaagcgggaaccataaacaataagccgtacaaaaatactctctgtgtcaactcgatgatgtggtattcgtaagcgcttaattttttcatgaatatcgagtatccgccaaacacgagagcagccccggctgccatgatgtctccgagcggatttagacgcagtaccacattgccgttaaacgtaatcaataaaagcccgatcagtgccgagacaaatccaatcaaaaaagtcagacgcagtttttcgccttcgagcagaaaatgggccaaaaccgcagtgatcatcggtataatggacacgatcatgccgacattggatgcgtatgtataggtgagagctatattttctaatagaaagtataaggttacgccaaataaaccagctccggcaaacaacagctcctgccgccaatttctgaacggaatcatgttgggacggacgaggataagagcgataaagcccatcaaaaaccgataaaataatatttccattggagagaagtcagccagcagaacttttgtcgaaataaaggtcgtcccccaaatcagaatggtcacaatggctgcgatatgccccgaagtttctctttgtatgttcatctgtgaagctccttttcaaaaatcttcatgtattgcttcggcgtcagccccacctgccgtttaaaaaacttcgtcatatgactctgatcgctgaatcctgtctgaaatgccgcatcaatcggccttaccccttgttcaaggagttttttggcttgattaatccggattgtttccatgtagctattaggggtaatgcctttttgttttgtaaatgaacgcaataaatgatacttgctccagcctgttaattcactcaaatcattgagtgtaacattttcggcataatgctcttctaaaaattcacaaaccattttgacttcgtctgatggttctggaacgctgctaaggaacgtgacatctgaataatggcggatcagctcctctaatagatgaagaaacagctcctccttacgcaaagcttgtttttcctcggatatcaaaatatgcaattcctgcaggctggctgtcagctcatggcggaataacacatgctgggagaaataagggagatgcccggagccagtaatctctttcaccgccttctccatgatatccggcatgacattgatacaccgataatcaagcgtccggccgtcaatctgttcacagctatgcgtgtcacgggggttaaagaggagaagatcacctggattgatgatatattcttgatcctgacaggccagataccgttgccctttttcaataaatccaatcacataataatcgtgaaagtggttcgggaacttctgcataattcccttgaagcggtaggcttctatatgaaggtgtgggtcaagctgcagtgtgcgggtttcgttttgcatgggatgcctcctgtcggtgtggtggtcttggattaagtgtagcatgatttagggggatttcttgtatgatgttgctgtttaggaatagagaaagcagaccgttattggtctgctttcttttnnnnnnnnnnnnnnnnnnnnnnnnnnnnnnnnattttgttttctttaataaaaatttatttttcaaatatttcagttataatggtttggaacagataggaggggcaaagatgtatcaatcaaagaaggttttattgttaggttcaggtgagttaggtaaagaggtagtgattgaagcccagcgtcttggggtacagacggtggcagttgacagttacgagcatgctccggcgatgcaggttgcgcataacagttatgtcgttgatatgctggaccacgagcagatcagagccatcattgagaaagaaaagccagatttgattgtgcctgaggtggaggcgatcgcgacggatgaattgctgaagcttgaagaggaaggatttcacgtcatcccgaatgcccgtgccgccaagctgacgatggatcgggaaggcatcagacggcttgcggcagaaacgctcggacttgcgacggctggctatgaatttgcgaatacatatgatgaatttatacaagcggcagcacagatcggttttccttgtgtcgttaaaccattgatgagttcttctggaaaaggccaaagtatctgccgctctgaagcggatttagagagctgctgggagacggcgatggaaggcggacgggtgaaaaacggccgcgtgatcgttgaggagtttatcccattcgaatcagaaatcacactcttaaccgtacgtgcggttaacggtacggcattttgcgagccgatcggtcatgtgcaaaaggacggggattatatcgaatcatggcagccgcatgatatgacagagcagcaaatagaagaagcgaagcatattgcgaaaacgatcacggatgagcttggcggatacggtctgtttggtgttgagctgttccttgcgaaagatagggtatatttcagtgaggtatctccccgtccgcatgatacgggtcttgtcacgctggtgacgcaaaatttgtcagaatttgcgctgcatgtccgggcgattctcggctttccgattacagaaatcacacagctttctcctggcgccagcaggcccctcaaagcgccggaagaattagcggattacactgttgaaggattggaaaacgcactggcagtcccaaagactcaaatgcgcgtctttggaaagccgataacgaaagccggacgtcgtatggcagttgcgctttctgctgctgatacagttgaaacggcaagagagaatgctaagaaagcgttggaccagctaacgataaaatagagtttgagcaggccttgtcatggtacaaggcctatttttttcttcctccataaaagttttatcataagaatcagaaacctgattataatgtaaaagtcttccatcaatacgggtggttgacactaaaggagggagatgacaaaatgaaattagttccaagattcagaaaacaatggttcgcttacttaacggttttgtgtttggctttggcagcagcggtttcttttggcgtaccggcaaaagcggcagagaacccgcaaacttctgtatcgaatactggtaaagaagctgatgccccgaaaaaccaaacgtcaaaagcagaacaggtttccgccccttatgagggaaccggaaaagcaagtaaatcgttatacggcggccaaacggaactggagaaaaatattcaaaccttacagccttcgagcattatcggaactgatgaacgcaccagaatctccagcacgacatcttttccatatagagcaaccgttcaactgtcaatcaagtatcccaacacttcaagcacttatggatgtaccggatttttagtcaatccaaatacagtcgtcacggctggacattgtgtgtacagccaggatcatggatgggcttcgacgataactgccgcgccgggccgcaatggttcgtcatatccgtacggtacttattcaggcacgatgttttactccgtcaaaggatggacggaaagcaaagacactaattatgattacggagctattaaattaaacggttctcctggaaacacggttggctggtacggctaccggactacaaacagcagcagtcccgtgggcctttcctcgtcagtgacaggattcccgtgtgacaaaacctttggcacgatgtggtctgatacaaagccgattcgctccgctgaaacgtataagctgacctatacaaccgatacgtacggctgccaaagcggctcgcctgtttatcgaaactacagtgatacagggcagacagcgattgccattcacacgaacggaggatcgtcatataacttgggaacaagggtgacgaacgatgtattcaacaatattcaatattgggcaaatcaataaatacagcaaattagccatattcatgtctattttgtttttatgcgggtgcagttcgcagacgcattcttctcaaaaagaaacgactattcctgtcactcttcatgtggaggatgctaaggggctgccggtcgaaggggttcaagtgacgattgtcaaagcgccctcttcagatgaggagccgagtacagagattggcgagatactcggtaaaacagacaaaaacggagatatcaaatgggataccggcagaaaaggcgattactcagtcgcgttgacgaagggtgaaacatcagtaacccatcacatctcgttaacagaggatatgaaagatcatgccattccattagtcttcaaagaatagcagtttccttgattttaagggaactgccttttttatttattgcaggaaaccaaactatatactggaaatttattatgtgagataataagaaataggtattttttcttacgagacaaaaggggcgttatcctttatatcaatcatacccggaggaaaaagaagaagatgatacaagattcaatgcagtttgccgcggttgaaagtggtctgcgcttttaccaggcatatgatcaaagcctttctttgtggccgattgagtcggaagcattctatgtttctactcgttttggaaaaacacatatcattgcaagtgggccaaaggacgcaccttcgctcattttgcttcacggaggccttttcagctctgcgatgtggtatccgaatatcgcagcgtggagcagtcaatttcgtacatatgcggtcgatataataggagacaaaaataaaagtataccatcatcagccatggaaacgagagctgattttgcagaatggatgaaagatgtctttgattctcttggacttgagacggcacacctggccggcctttcgcttggcgggtcccatatcgtgaatttcttactccgcgcgcctgaaagagtagagcgggcggttgttatgagtcccgctgaagcgtttatttcatttcatccggatgtctataaatacgctgcagagcttacaggggcaagaggagctgaatcatatatcaagtggatcacaggcgacagttatgatctgcatcctttactgcaaagacaaattgtggcgggcgtggaatggcaggatgagcaaaggagcctgaagccgacagaaaacggctttccgtacgtgttcacagaccaggaattgaaatcgatacaagtcccggtactgctgatgttcggtgagcacgaggccatgtaccatcagcaaatggcctttgagcgggcttcggtattggtgccgggaattcaggctgaaatcgtaaagaacgccggacatctgttatctctggagcagtcagagtacgtcaatcaacgcgtcttgtcctttttatgcgggggaataaaatagtaaggaacatgaaaagattggcattcatttttcaaaaggtaacaaatgttgtataataatagaatttgaatgctgctttttttgtgagcattctatgttatcatgcttattggagaaaaatttttcctgtaacgctattcgatcactatcgtcaaataatatagatggttttacaattggaggtttggttacactgtgaattacatcccctgtatgattacgataggaaacttcatttgcggattgctggcgattcattccttgctatatcacaacattcattcagcagtgctttttatttttacaggcatgttccttgatttctttgacgggatggctgctcgtaagctgaatgccgtttctgatatggggagagaactggattcgtttgccgatctggttacgtttggggtggctccttctatgcttgcttacagtgtcgcgttgtataccctgccatttatcgggatcttatgcgcattgacgtacagcatttgcggaatgcttcgcctctctaaatttaacattgaacaaagcaagctcccgacgtttatcggtatgccgattccgtttgcgggcatgtgtctcgttattttaagcttcacctataacccgatccttctggcaatcggcacttgcggactctcatatttgatggtgagtaaaataaaattccctcattttaaaaaacatgcggcagaaaacctggagtctgggagatggaattagttcagcagctcatagcggattacggttatctcgctatttttttgatgttggtattagggattgtaggattgccgattccagatgaagtaatgatgaccgttgttggctatttcacgcataccgatgtgttgaattatgagctttcgatattgattagttttgtcggggctttgttaggtatgctgatcagctacatgattggcagaaaagccggacgcccgtttatcgacaagtacggcaagtgggtcggcttaaaagaaaaaagaatgatgaaagtggaaaaatggatgaagaaatacggtccatattctcttattttaggttattttattcccggcgtcagacatgtgacgtgctacttttcggggatcggcaaaatggatctgaaaacgtatgttgcgtttgcggcaatcggcgcctttttatggtgctttgtttttattacaatcggaagggttatagggattattcatgtttaatacggctgtaaagattctgtatcgatcattgatagagctgacgaatcatcgtctgtcatcctatctgattaaaggattttgcgagtcaaaaatcagcaaaccggtcattccgcttttctcaaaacattttcggctgaattgggatgatgtggacggtacggctgctgattacggatcgctgtctgaattgtttattcgacaaataaatctggagcggcgccctgtgtcaaaagaggcgcatgcggtggtcagccctgttgacggtgtggttcagacggtaggaatcatcaacccgaatcaaacctttacggtgaagggaaaagattactcattcgctgaactgaccggctgtaaaagcgcagaccatcaatacaacggcggatacttcgtcgtgctgtatttaagcccgaggcattatcaccgtttccattctccgattagctgcaggtatcaaaagctggccgagctcggaaatcgctcatacccggtaaatcaattaggcttaaaatacgggaaagatgtgctgtcgaaaaattaccgatttgtgtacgagctgaatagcggcagccgaaatgtcctgatgattcctgtcggcgcgatgaatattaattctatcgtgcagacgaatacccgtactgaattggagatcggcgaagagctgggatacttttcatttggctcaaccgtcattttgatttttgaaaaagacgcgttccagccgtccgcccatttagcagaaggccaagaagttcaagtcggagaactgataggttatgaagagtaaaaagaggagcttgcataaacgcagcgcctctttttttgaagaaaggtgagacttatggagaaacaaatcatcagctggattacagattatcagaacaccggagatgaagccgtcctgcggcaagtgcgagaagtgtgctggccgatcattgaagcggttttgcaagagaaggcaatagatgatgaacaagcgaacaatttgcgcgaaaaaggaatcgagcggtttccattcatcatcagcaaataccaagcggatgtgcagcttccggttgagacatttttacgaaatacgtatcggttttactttcatcaggtgatgagagaatccagctaaagcttctttcaacagagaagctttttttgttggtgaaaaaaggaatctttttctatatctatctcgtaatgactagagaacctagcagaaaaggagagatagaattgaaacgaatgatagtgagaatgactctgccgctgctgattgtctgtctggcgttttcttctttttcagtctcggcacgtgctgcttctgaagaaaaatattgggattcatggattgaacgacatgcacagccactggatgcttccaatgcttcaaacaaagaccttcgatttctaaagaaggtgctgaaagggaaacgaatcgttcagttaggggaaacgacacatggagctggtgaaatcaacgccacaaaggtcagaatgatcaaatatctccacgaagagctgggatacgatgtattggcatttgagtctggctttcctgatacaaatgcatcctaccttaatatggaccaattaacccctaaaagcacgatgaaaaactccatttacgctgtatggcacacagaagatgtcgttgaattgtttgattacatgaaagagcaaaaagagaaaggcgatccgctgatccttaccggttttgatattcaaagcatgaagaattcattcaatgatgctgcgactcattgggtaaaagcggtggaccctgagaaagcagagttgctctcccaatcagaaaatgatttttcaacattagtgacagacagcaatacgtttgatgaattttcgcaaaagaaggaaaagcttgtgaaaaactatcagaagctgatcaagttcactaaaacacatgcttcagagctaaaagaaaaccttccaaaagagccgaaagcttatgagatgtttatgcattctcttcagctgagaattgacgtaatggaaacatatatgctggaagaaatgaaagaaaaactagaggagtatccggagaatattgaggatttttcattctttatgagagaccgcatgatggctgaacaatttcagtgggtagccgacaccctttatccgaaaaagaaaatcattgtctggggccacaattaccatctacgcaaacagaatacgaagatgataaaggactgggtacagctaaacggccctaacatgggtgattatttgccggagcggctgaaaaaacaaacatatacgattggcatttatgcttactcaggtgcgagtcttgatagctccgataataagactgttaagccggttacaagcccgccgccgtctgggagccttgaagctttgctgaaagcggcggaccgaccggctgtttttgttgattttctccatacaaaaaacaagaaaggcacttcgtggatgtataccccgcggactgcgctctattgggggtacatggaagagcagatgatcctgaaggaacaatatgacggtgtcatttggctggagcatatcacgccctctgtcattatcaagtgagcggtgtcccctgtggtaaacaggggatttttacatatcgcaaaaataatcaaaacatataatccgtgatccattattctaaaacagaaaggagattggagcgtgcaatgtattatgaaaaagctgtccagaaaacaatcaattggattgaatcacatttacatgagcaaatatcaaacgaggatattgttaacgtttcaagcttttcaaaattccattttcatcggatttttcaaaaagaagtcggcatgtcggttgcttcttatattcggttaagacgtcttgcgaatgcggcggcagctttgctttatacagatcatcgtattatcgatattgctttgtattatcagtttgaatctcaagaagcatttacgaggacgttcaaaaagatgtatcacatgccgccaggagcataccgaacatttatgaaacgctttacttcaaaaaaggaggaatcttacatggagaaaaaaatgaaaggctgggtattgagcgggagccatccgttccaattcgaaatggggattgaccgggaaaatgtacatcagggaaaagcttcagggtatttaaagtcaacgatggttcaggatatcggtgaatttgcgacgatgatgcagcaattcaaagcagatcgctatctaggaaaaaggcttcgtctatcaagttttatcaaaacaaagggggtgcagcattttgcctcactttggatgcgggttgacagtgctgctgatgatgttctccaatttgataatatgagcaacagacctattaccggaacaaccaattggaatcattatgctatcgttttagatgtcccagaaaatagcgctgtgatatcttttggcgttcaattatctgggccgggtcaggtgtggatggatcatgttgtttttgaagaggtagatgagagcgttccttcaacaaaccttgaaatgccgggagaacttttagatgaaccggtaaatttatcttttgaagaggaactacaaaaatagttttcagacaactacttttattagtgagttaatggaaaatactatttgttattaataaacccttgtgctgcttaggtttgtaagagcttggatatttttatcagtctgggcggatctgttcatctttgcggcattttcctgtatgatatagtaagagtgtgcatagcaactaactataattgaacagggtgtttaaaacatggaaaaacaatacagagtattactttactataaatatgttccgattgaagatccagaggcgtttagagagcagcatctggctttttgtaaggagcttggtttgttaggccgtatccttgtttcttctgaaggaattaacggtacggtatcaggtacggttgaacagactgaaaaatatatggaaacaatgaaagctgatcctcgctttgcggacatggtatttaaaattgatgaagcagaaggccatgccttcaaaaaaatcttcgtccgccataaaaaagagcttgtaacgcttcgtcttgaagatgatgtcgatccgaacgaaacaacaggccagcatttgaagcctgcagaattttatgagaagatgcaggatccaaacacaattgtcatcgacgcgcgtaacgattacgagtatgaccttggccatttcagaggtgcggtccgtcctgacatcgaagccttccgtgaattacctgaatggattgaagagcacaaagatatgcttgaaggcaaaaagattttaacgtactgtacaggcggcgtgcgctgtgaaaagttctcaggatggctggtgaagcaaggctttgaagatgtagctcagcttgatggcggaatcgtgacatacggaaaagatccagaggtgcaaggcaagctttgggacggccagtgctacgtatttgatgaaagaatcagcgtgcctgtcaaccgtgtcgagcatgtgattgtcggcaaggactactttacaggagaaccgtgtgagcgttatgtgaactgcgcaaatccatcttgcaataaaaaaatgatatgcacaccggaaaatgagtataaatatatgcgcagctgcagccacgaatgccgcacgaacccaagaaacctgtatgtgaaagagcataatatgacagaagaagaagtaaacgcaagactggcagcgattgaaacagaagatcacgctgctgctgaataaaaaaagaacacctcgtattgaggtgttctttttttctatatgctttcagtttggctgtttgcggaaacccattctttttggcggaaggccttttcccattttgataccacgatacaggcgatcgcatgtcccggtacgttcacgcccgttctcgccatgtccatgacgcggtcaacacccgctataatggcaacgccttcagccggcagtcctacagcattggcagtcgccagaagaactacaagcgatcctgagggtacagctgcaatgcctttactggtcatcacaagcacaagcatcatgagcagctgctgggacaatgtcatgtctacttgaaaggcctgtgcgagaaagatacaagaaaccgataaatataagctggagccgtcacagttcaatgacaagccggagggaacgacaaatgataccactcgtttgggacagccgtatttctccattctatccatcagctgagggagaatggtttcagtgctggtggtggaaaatgcaattaaaaacagatcccatatcattttcaatacttcgaaatacttaatctgaaagatgagaccgacaagcggaaagaggacaaagaggatcaggaacaggccaaggaatacggtgccaaccagcttaaacatagggaggaggagttcaatgccatattggcccacagaagctgccatcagggctaacacgccgataggagcagtgaccatgacgatttgcgtgagcttgaacataatctgagcggtagattcaaaaaacttcattactggttcagaagctttgccgataccagctgcggcgacaccaaataaaatggcgaagaaaataacggcaagcaaatcatttctggccatgacatcaataatgtttgtagggataatatccaggaccatttgcttgaaatcaacaactttgtctgtgtagccggaaagttcatgaatatctttttttgccaaatgggagaggtcaagcccgacacctggttttaagacattcgctaataaaagtccaagccctaataccaacgttgtaatcacttcgaaccaaatgatcgtcttgatgccgaggctgcccatttttttcatgcttccgcttcctgcggctccaatgacaatggtagaaaatacaatcggcacaacaatcattttaatcaggcggataaatccatctccgacaggcctcagtgccatcccgaaatcaggaaaaaagtggccgatcaccgcgccgacagccaaagcgattaaaatttgaaacgcgattaattttttcaaatgaatccccctttagaacgatagaatgtaggcatattcatatcattcgtgattcaaatgcaaacaccttttttcaagttattttattttgatagcgctttcattatgttggcgaaaaagtcccccacagcaggggggacttttttacttcatttgaatgtgctttagatcttcttcagaggtatttgtgaaaataaccggtgttatggctgaagcggcatgctgcttgatataatcgagatcaagggtgagaagcagttcgccttgtttgacggcttgtccgcttgtgacatgtgcttcaaagccttccccattcagtttgacggtatcgatgccgacatgaatcaggatttcagtgccgccggcgctcataaagccgatggcgtgttttgtcggaaaaatcgagacgatctcgccttccgcaggtgcaacgacttttccttctgatggtataatcgcaaatccctcgcccatcattttttctgaaaagacttgatcaggcacatcccctaaagagactgtttctcctttaatcggatagataaaggtctcaccggaatcgggcttcagcggtttgtcagttaccgtgtccagcgcggcgacggtggcagggacgcctccggccatgatggttttgatgtcgtcttttaaggcatcggacttggttccgaatattgcctggaagttgttgttgacctccagcacacctactgcaccaagccgttttaattcatccttgctgacttggcttggctgatgaacggtcacacgaagccttgtgatacatgcatccaggttagcgatattttgctgtccgcccaaggcctgcagcacgtgaaaggcaagctggtcttttgcaactggagctttctcctcattctgaccgtcttcatctgtctcacggccgggcgttttcaaattccatttcagaatcgcaaatcggaacaaataataataaatgaaagcaaacacgatcccgacaggaatgacaacccaaccgtttgtagacagtccgtagttcaagacgtagtcaattccgccgcctgagaacgtatagccgtggcggacatggaataaatcacaaacgacaaagatgacgccggcaagaatagagttaatcaaatagagcacaggcgcaacgaacaagaaagaaaactcaaccggttctgtaattccggtcagcatagatgtgagcgccgcagaaatcatcacgccggagatcatttttttcttttccggacgcgcggtatggataatggcaagagcaactgccggcagacagaaaatcatgtaagggaaatcccccatcataaagcgcccggctgtcgggtctcccgcgaaaaaccttgtcaggtctccggttacggtgttgcctgttgatgggtctgtgtattctcccatcataaaatagaaaggcgtataaaaaatatgatgcaggccaaaaggaatcagcaaacgatagatcgttgcataaaagaacaggccgactgttgaatcggcaattaaactgctggctgcgttaattccgttttggattagcggccaaacgaatgagaaaatgacgccgatcaccaatgaactgacggaagtaataatcgggacaaagcgttttccagagaaaaatccaaggaccggatgcagctcgattgatgaaaatcgcttatataaataggcggcgagaagcccgataatgattcctccgaaaacccccatatcaatcaggtgctcggctccttcatacggaggctgaaggccgagtaattttcccatattgtcgagggtgacggttaaaattaagtatccgatgacagctgcaagtccggctacaccttctccgccggctaatccgatcgcgacccccacggcgaaaatcagcggaaggttatcgaatacaacgccgcccgcatcctttataatagggatgttcagtaaatccttgtctccgaaacggagcaaaagacctgctgccggcaggacggcaaccggagtcatcaacgcgcggccaagctgctgcagaatttgaaatgcctttttaaacatgacagtctccttttattgttttatgagcatggtgcactctttaatttttgagctgctttataatcggcgataacggttacatgattgtgtttttgaagaatggaggctggtacttctgtcgtgacaggaccttcagccatcttttgaatggcgtctgctttttcctcgccgcttgctaaaagcacaatatgtttgctgaattccatgatggttttaatgcccattgaaatcgcgagtctcggcaccagcaccggatcaccgccgaagaatctagcatttgcctgtatcgtgctttccgagagcttcacaacacgtgtccggtcctcaaaatcagatcccggttcattgaaaccgatatggccattggcgccgatgccgagaatttggacatcaatgcctcccgcctggcggatgagaacctcgtatactttgcattccgcctcaagctgcgggttgtctccttgcgggatatgaatatgatcaggctgcatattgatatgctgaaatagatgctcatgcataaagtggttataactttgcggatgagatggagagagaccagcgtattcatccaaattaaatgtagtaacctttgaaaaatcaatttcgcctgcctgatagtctgaaatcaactgcttatacaagccgaccggtgtgcttcctgttgccaggccgagaacggcatctttcttagcttgtatttgttctttaataatggcagcgcttaacttacagagttcttcgtagtgctcggcgatcagaatcttcatgtgacaccccctcaaagagatagacaagcaccttatttgttatgaccaatttatgatacttgtcattacgaatttagcaccgcccttatcaaactgtcaatttctgaaaatttgttataaaagaaggatacaaatctttcatattgggatggcaaatggtattatggtctcaatgaaaaagaacggaatgcatacagaatggggagaatgaaatgacagctttatattctgttatcaagtttaaaatcattgagttaattaaatcgggcaaatatcaggcgaatgatcagctgccgacggagagtgagttttgcgaacaatatgatgtcagcagaacaactgtgagactggctctgcagcagctagagcttgagggatatattaaaagaattcaaggaaaagggacatttgtatcggcggcaaaaatacaaacgccgattccgcataagattacgagctttgcagaacaaatgagaggacttcgttctgaatcaaaagtgcttgagcttgtggtgattcctgccgatcattccatcgctgagcttttgaaaatgaaagagaatgaacctgtcaacaagcttgtcagagtcagatacgccgagggggaacctttgcagtatcatacctcatatattccctggaaggcggcaccggggctggcgcaggaggaatgcaccggctcgctgtttgaattgttaaggacaaaatacaatattgaaatcagcaggggcacggaatcgatcgaaccgattttaacggatgaaacgatcagcggacacttattaaccaatgtcggagcgcctgcgtttttatcagaatcccttacctatgataaaaatgaagaagtggtggaatatgcgcaaattattacacggggagaccgaacgaaattcaccgtagaacagtcatatcattcataaagcaatgtgttttaagaagggaatggtggttctatgtttttatttacgaatggaaaagtgctgtggggagcagtgattgctgcattcatcctttcaattgtattttacccttttctgccgacgcagatgccgattcattatgatgttgcgaacagtccggatctgacggttaacaagctggcggggactgtgatgctgcctgttttgatggtggtgtttgcatgggcgcggaagatcaattggcaatttgtattcgcagtgtatattttgctgatttgccacattgtcgtcctttgtttagcgctctaaatcaaacagccagaataaaactggctgttttctttaatttcagcttcatctgacaatgaatgtagtgtataatagctgatgatcctaaagaatattctgaaatttataggtgtgaagcggcgtattattaaaggaaaggctgtatactttttgcagctttaaaaagactgaatatttaaacaattatgtgaaaggtgtgctgattagattgaataagcttattgaacgagaaaaaactgtatattataaggaaaagcccgacccgtcttccttggggtttggacaatattttacagattatatgtttgtgatggactacgaagaggggattggatggcatcatccgagaattgcgccgtacgcaccgcttacgcttgatccgtcttcatctgtttttcattacggccaggctgtttttgaaggattaaaagcatacagaacagacgacggcagagtgctgctgttccgtccggatcaaaatatcaaacggctgaacagatcgtgtgagcgcatgagcatgccctctttagacgaagagctggtccttgaggcattgacacaattagttgagctggagaaagattgggttccaaagaaaaaaggaacgtcactgtatattcgtccttttgtcattgccacagaaccgagtctcggtgtgaaggcatccaggagctatacatttatgatcgtgctttcgcctgtcggctcctattatggcgacgatcagctgaagccggttagaatctatgtcgaagatgagtatgtgcgggcggtcaacggaggagtcgggtttgcaaaaacggctggaaactatgccgccagtcttcaggcacagcggaaagcgaatgaactgggctatgaccaggtactgtggctggacgccatcgaaaagaaatatgtggaagaagtagggagcatgaacatctttttcgtcataaacggggaagctgtcacacctgctttaagcggaagcattttaagcggggttacacgtgcgtctgcgattgaattgattcgaagctggggcattccggttcgtgaagagagaatatcgattgatgaggtgtatgcggcctctgcacgcggagaattgacagaggtcttcggcacaggcacggcagccgtcgttacgcctgtcggtgaactcaacattcatggaaaaacggtgattgtaggagacgggcaaatcggggacctctcgaaaaagctgtatgaaacgataacagatattcagcttggcaaggtgaaaggcccgtttaactggacagtggaagtgtgaaaatcgaaaaagaacctgcccgaaggcaggttctttttattttgaataagtcatatcagcagccggctggcttttgcggttttttacataatatattgcatagcaaatggccataaatggaacgccgcaatagagtgcgattctttgattcggatcaaaggcaatgccaacaacggaagccaggcataacaggaacgcagcaatcggcacgaacggatacaaaggggttctgtatttcaaatcagtaaccttgtttcccgcttcgatataacgttttctgaacatgaattgagaagcagcgattcccatccacacgacaacgacggcaaaaccggaaatcgacacgagcacaacgtatacagtgtctggcgcaaatacgctggacagcaacgacagaatgccgccgatcatgctgaacaccagcgcgttaaaaggggttccttttgacgtcagctttgcaaatgtcggatgaagcgttttttcttttgataaagaccacagcatccgggaagaagcgtagagtccggaattagccgctgacaggatcgctgtcaggataacaaagttcatgatatcggctgcgtatggtacaccgactctgtcaaagacagcgacaaacgggcttttgatgacacctgcatcttgaatcggaatcagccctgacagcacaaaaattgttccgacaaagaagagtgagagacgccagaccgttgttttaatcgcttttggtattgtcttgtcaggatcaacgctttcaccggctgcgattccgattagttccgttcccgaaaaggcaaaattaacggacagcatcgtcatcaaaatcgggacaaatccatttggaaaaagcccgccttccgccatgaagttggacagcatcggagcggcttctccgcctttgatcggaatgatgccaaacatggcagagccgcctaaaagaataaataatacaatggctaatactttgatgctggaaaaccaaaattctgattcagcgaaaaacttgaccgaaaatgcgttaagcaagaaaatgaacagcgcaaagacggcactccacatccaaaccgatgtatgggggaaccagcgctgcattaacaggccggctgctgtgaattctgatcccaatgccacggtccatgtcagccagtacagccaagcgaccgtaaatccggtgcccggccctatgtatttggctgcataggtgtgaaaggcgccggtcacaggcatggcgactgacagctcaccgaggcagagcatgaccagatagacgatgccggcaccgactaagtaggcgagtatcgttccggccgggcctgcttgctgaatggtataacctgagcttaaaaacagcccggttccgatgacacctcccaaggaaagcataaagaggtgccggcttttcatacttctctgaaaggttgtctcattcttgttgtgggcagagttcatctttttccaactttctatcagcgatttatttcctcctaataaaaaatctcatgtcagaaagtgacacgagacgccggcgaaccggctttaagttagaatatacaaactattccgataagtcaagttgtttttaaagagcgggcccaagccgcaatttcttgaatattttcgggttttgtccgacagcagcccccaatcagcctcgctcctttttcatgccaggtgcgggcgctcgccccgtaagattctgcgcatgctgcgccgttccatgtttttgtttccggatcatattgctcacctgaattcgggtagacaatgatcggttttgacgtgttcttttttaactcctctatcaaggaagggatatgctgaagcggcgtgcagttgatgccgagtgctgcaatttggcggtgttcatcaagccatgatgcgcagtcagctgcaggtgttccgtcactgatatgcaggccgtctttagcactgaagctgatccatgcatacgtttcaggaaattccttcaacagccgaacaatcgctttggcttcagtcagacacggaatcgtttcgcatgccaatacatcagctccggcttcaatcagcgccttcatccgggggcgatgaaattcaatcagttcatcttctgatattgcgtagttgccgcgatactcagacccgtctgcaagataagcgccataagggcctacagaagccgcaatgatcggttttggccgattcaaacggttctcttcaagcgaccaaaattcatcacgtgcttcagctgcgatgctgacggacaactcgatgagccggcgtgcttccgcttcgctcagcccgcgtgcggcaaagccttcaaatgtagactgatagctggcagtgattgcacaatcggcgcctgccgcgaaataatcagtatgtacttgtttaatcagatttggctcttccatcaggatttttgccgaccacagactgtcattcaaattacagcccttgcgttcaagctcggtcgccatggcgccgtctagcacaataagcgggtatgtatctaatatgtgttggataggattcatagaatgtaccgatgccttctttcagatttttttgaaaaagatatgaaaatcgtaatggaggcttacgtgtttgtcaataaacgcaaaaagagaaaggtgttcagcccatatgtctgaacacccttttcttatgatatttgtttgttgtgcgtgtcagtctttgtgtctgaaaccggccagcactcaatgccattatggtttttgagcacatctttataaaagaccggatccttgcctgcttttttctggcgtgtatagtctttcagcgccgtaaaaacgacctttgatagtaagaaaatcgcgattaaattcacgatgaccatcaaacccatgaacaaatcagcaagatcccagacgagctggactttggcaacacagccaaacacgatcattgccagcacgccgatacggtagacaaaaatcagttttttgcttttgttcaaaaagccgatattggtttcgccataataatagtttccaattagagcacagaatccgaataacaaaatcagaatcgcgagaaagcctgatgcccatgatccgacatgggagctgagggaggcttgtgtcaaggcgattccgctcagacccggagtatgataggcatccgaaaacaggatgataaaggcggtgcttgtacaaatgaccagtgtatctgtcagtacaccaaaagcttggatcagcccctgtttgacgggatggcttgttgtggcggtggcagcggcattcggtgcgcttcccattcccgcttcgtttgaaaagattccccgtctgacgccttgcatgagtgccgcgcccaaagccccgccggcggcctgatcaaaaccaaacgcatttttcacgattagcgcaagcacacctggcagctgcgtaatgttggtgaaaatgacgaaaaacgcaactccgatatacaggacagccaatacgacgacaatggattcagccagctttgcaatgcgcttgactccgccaaaaataatcgtgccgaatacagcaattaaaatgagtcccaatgtcaggcggtttgtgccaaacgcgttttcaaaggcaaggctgactgtattggattgaaccgagttgaagacgataccgaacgataaggtgattaacacagcgaacagcgcgcccatccaccttttgttcagccctttttccatgtaatacgccggcccgccgcggaagccgtttacatcttttactttataaatctgagccagtgtgctttccacaaagctggatgctgatccgataatggcgataatccacatccagaagattgcaccgggcccgccgagtgcaatggcgatggcaatgcccgtaatatttcccgttccgacacgggccgccatgctgatgcaaaaggcttgaaacggagaaatggtgtttttcgaccgggaagcagcaccttctcttaataccctgaccatttctttcagcatgcgaacctgtaaaaacttaagcctgaacgtaaaatagattcccagagaaaggagcaaaacaattaataactttgaccacaaaagatcatttgcgatacccacgatatgttccaggatttgctgcatagaatcacctcttttttcatatttaaaaaatgctgagctcccactcctgcgccatatgcttcagcagcataccgccagtgaggctgttaccgtattcatcaatggcaggcccgtaaatgccgatgccgcatccggattgaaaaggctgttctcttctggcgcttggaggcaccagcgccatgatgccgccggagacgccgcttttggccggcacgccgacaaacgccgcatatttgcctgaagcgttgtacatgccgcacgtcagcattaacgccttggccaattttgccacatcttttggaatcacctgctcgcgtcgaatcggatgatacccgtcatgagcaaggatcaggccgatcaacgcaatatcttctgtggtgctctccatagcgcattgcttcaagtacacctcaagtgtttcttctacttcagcttctaaaaagtttgtttcttttaaatagtaggccagcgctctgttgcggtgggcggtttcccattcagaacggaatacttcctcatgaattctcggccgttttcctatcaaagtttccatcaccgagtaaagaaactctagcttttcgtatgccgattctccgggaagaatcgaagcgatggtgagggcgcccgcgttgatcatgggattgaagggctttcccggcttgttgatttcgagccgaatgattgaattaaaggcgtcgcctgtcggctcgacatctacgcggtccagcacatagggaatgccgcggctcatgcaggcggcaataaagctaatcacttttgaaatgctttgcagggtaaaagagacgttccagtcgccggcgtgtatcatcgttccatcaggctccaatacacagatgccgagctgtgaatcattgacttttcctaaagcggggatatagtttgcgctttgtccattggcggcaaaagggcgatagtattcaacccaatcatgaagctgtaacgccgggtttatgtctttctggtgctcttttatcaattctttcatcgaattcctcctcactgatttttttcttaaaaggactgaggtgtatcaaaacgaaggctaaaggggcgttaaacgctttcataatagcggaaggtataattactgtataatggagactacagaatcatacaaaatacgacaaaaacattttgaaaataagcagtaagatttataaaaacctcatgttctgggtcaaaagcaatttgcaggttttctcccgattccccaaaataaaaagcgaggatgtgatcaacataaaactggaacggtttattgaaaaagacggatatatactggccctcatgctgattacggtgccgctggccggtgaactgaaattttatcccctcaatgaagaattccgggtcagctttggggcaccggtttttttcttctttttatcgttgttgcggcaagtgcccgctgtgctgccgggttttctgactggagcggctgttttcatctttcgcgtctttctggaattatggggcggaggacacaatgggctgactccgattctgtatgatcaagcgtctggctttttcttttatatgacttacgcctgtctgttttccatattaaaggccaatcgtttccgtgaacggccgattatgctcggtttcattgggtttatgattgaagttgtgtcagattgtgtcgagctaactgtgcaatttctcatttttcatacggttgtcacgcctgagaaaatcactgacattgcggtgattgcgatttctcacacatttattgtgatgagcttttatagtgtgctgaagctgtatgaaacacaatcgagagaaaaacagacaaggcagcagcacgagcacatgctgatgatcgtttccaatttatatgaagaaacggtgcacctaaaaaagacattgaaaacgacagagaaagtgacaaacgattcgtatcagctctatcgggaaatgaaggtcaaggatgttcagctgagcggcagaatcttgagactggccggagagattcatgaagtgaaaaaggacaaccagcggatattcgcagggctttcaaaactgatttcgaatgagagtttgagagattatatgagggcttctgatttgctgcagctcgtgattcgaatgaatgaaaagtacgctgaagcactagggaagcagattgatttttactgctcgatcgagggagagcatgacgaatatcacgtatttatcgtgctttcgatcattaataatctaacagcaaatgcggtagaggctatggatgaagagggaatggtcagcctgaggctccgtaagccaaatgagagtatggtagaattccaggtggaagacaatggccccgggatttccgagaaaatcggagacattgtgtttgacccgggctttacttcaaaatatgacgaatttggcacgccttctacgggtatcggactttcctacgtaaaggaaatcgtgacagagctagaaggggatatcacgtttgataatcagcagcggggagtggtgtttgccatcaggctgcctgtccggcatttgattcagaaagggtgaaccaaaagctatgcgtttttttattgcagatgatgaccgtgcggtgcggtcaattttaaggcagatcattgaggacgaagatctcggggaagctgctggtgaagcagacgacggaagccaagtggaagggcatatgctgcaatttaagcagattgatattttattaatcgatctgttaatgcccggaagagacggcattgagacgattcgtcagatccagaatacgtactccggcaaaatcgtaatgatctctcaagtggaggcgaaggaaatggtcggggaagcgtactcgctcggcatcgaatattttatccataagccgattaaccgcattgaaattgtcacggttctccaaaaggtgaaggagcggatcgagcttgaacactcgattggagccattcaacattctctaagccggcttgtcaatcggactgaacggaaagcgcgtccccagcagaagagtgacagcggtttaaaagaggcaggaacattcctgttgtccgagctgggcatgatgggagaaggcggcgcacatgatctcatggcggtcctgcagtatttagcagaacacgagcaatccgagccgcacgaaaaacaaagcccttcgctaaaacaaatattcacccaagtagcggtacggaagctgggcacaggggcctcacagacggaagtcaatcgcgaaatgaaagcctcggagcagcgtatccgcagagcgattattcattcgctgcaccattttgcttcactgggcacaactgatttttcgaatccaaaatttgaaacctatgcatcgaaattctttgattttccggttgtcagccagaaaatgaaagaactccaatccaaggatgcaaaaccccttgcacctgctagaataaatatgaaaaaattcatccacgtgttttttttggaagcaaagcttttgcatgagacgatgaaacaaagaaggatataaaccaaacagccggctgacctggctgtttttttgctgagcagaatcccggccggacagtgatttaccgcttttttataaaatatcagaaaataaagatattgacttattgtttatttgtcttacaattaaacaaaaggatatatggggaaggagcggatgtgaaagaaaaattaataaaagcgcttacagatagaggctgtatacacaaataacaggaggttatgttgatgagccgtatcagaaaagcacccgctggaattttaggttttccggttgctccttttaacacacaaggaaaactggaggaagaagctctttttcaaaacattgagtttttgctgaatgagggcttggaagcgatatttattgcttgcgggtctggtgagttccaatctctcagccagaaggaatatgagcaaatggtggaagtcgcagtctcggcagccggaggaaaggtgccggtctacacgggggtgggcggcaacctcagcacagcgcttgattgggcgcagctgtcggagaaaaaaggcgccgacggctacttgatcctgcctccgtatttggtgcatggcgaacaggaggggctgtaccagtatgcgaaaacgattattgaaagcactgacttgaacgcgattctttatcagcgcgataacgccgttctctctgttgaacagatcaaacgtctgaccgaatgtgaacagcttgtcggtgtcaaagacggggtaggaaatatggatttgaatatcaacctcgtctatacgatcggcgaccgcttaggatggctcaacggaatgccgatggctgaagtgacgatgccggcttatctgccgatcgggttccactcttactcttcagcgatttcaaattatatcccgcatatttcgcgaatgttctatgatgcattgaaaaatggaaatgacgagcttgtgaaggaactctatcggcatgtgattctgccgatcaacgacattcgcaaacaacgaaaaggctacgccgtatccttgattaaagccggtatggaaatcatgggtttgaatgtaaggaatacagccagaccgcctgtcggcccggttgaaaaagatcattatcagcaattggaagcaattttgaagcaggcggctgaccgttttccgaaaaaagccgcgacggtttgaccagaaaaaacacgaaaggggcaatgggcatgtctgtgatcacggaacaaaacacgtacctcaactttattaacggagagtgggttaagtctcaatcaggcgatatggtcaaggtcgaaaaccctgccgatgtgaatgacattgtcggatatgtacagaattcaacggctgaagatgtggaacgtgccgtcgccgccgccaatgaagccaaaacggcttggagaaagctgacgggtgccgagcgcggccaatacttatacaaaacagcggatatcatggagcagcgcttggaggaaatcgccgcctgtgcaacgcgtgaaatgggtaaaacattgccggaagcgaagggagaaacagcccgggggattgccattctgcgctattacgccggagagggcatgcgaaaaacgggtgacgtcattccgtctactgacaaagccgcgctcatgtttaccacccgtgttccgctcggtgtggtcggcgtgatttctccgtggaacttcccagtggcgattccgatttggaaaatggcgccggcattggtatacggcaataccgttgtcatcaaaccggcgacagaaacagctgtgacatgcgcaaagatcattgcctgctttgaggaagcggggctcccggcaggggtcatcaatttggtgacaggcccgggttctgttgtcgggcaggggcttgctgagcatgacggtgtaaacgccgttacgtttaccggttcaaatcaagtcggaaaaatcatcgggcaagccgctttagcgaggggagccaaatatcagcttgagatgggcggcaaaaaccctgtcatcgtagctgatgacgctgaccttgaagctgcggccgaagctgtcataacgggggccttccgttcaaccggccagaaatgcaccgcgacaagccgtgtcatcgtacaaagcggaatttacgagcgctttaaagaaaaactgctccagcgcacaaaagatattacaatcggagacagcttaaaagaggatgtctggatggggccgatagccagcaagaatcagcttgataactgcctgtcatacattgagaaaggcaaacaggagggcgcttcccttttaataggaggagaaaagctggagaacggaaagtatcaaaacggctattatgttcagcctgccatctttgacaatgtgacatctgagatgacaattgcccaggaggaaattttcggtccggtgatcgtcttgatcaaggtggactcgatggaggaggcgctgaacatcgccaatgatgtgaagttcggtttaagtgcatccatcttcacggaaaacatcggccgaatgctttctttcattgatgaaatcgatgccgggctggttcggatcaatgcagaaagcgcaggtgttgagctgcaggcgccttttggcggcatgaagcagtcgagctcccactcccgagaacagggtgaggcagcgaaggactttttcacagcgatcaaaactgtttttatgaagccgtaatggtgctggaaagaggcgtgcgtctctttcccggctttatcacaaccagcatatgattctctactttgaaaaggagaagatactatgaaaaaagactttgcgagtgttactccggcgggcaaaaaaacgtccgtgcgctggtttatcgtgtttatgctgtttcttgtgacctctattaactacgcggatcgagcgacgctttccatcaccggagattccgtccagcacgatttgggattggactcggtcgccatgggatatgtcttttctgcctttggctgggcctatgtcatcggacagcttccgggcggctggctgctggaccgttttggttcaaagactatcattgcgttaagcatctttttctggtcgttttttacgctgctgcaaggggcgattggctttttctccgccggcacagcgattatcctgctgtttgcactgcgttttctggttggtttatcagaagcgccttcatttcccggaaacggcagagttgttgcctcatggtttccaagctccgagcgcgggacagcttcagccttttttaattctgcacaatacttcgcaatcgtcattttttctcctttaatgggctggcttacccactctttcggctggcattccgtcttcgttgtcatgggtattgcaggcattcttctggctgtcatctggctaaaaacggtgtatgaaccgaaaaaacatccgaaggttaatgaagctgagcttgcgtacatcgaacagggcggcgggctgatttccatggatgacagtaaaagcaaacaagaaacagaatcgaaatggctgtatatcaaacagctgttaacgaaccgcatgctgattggcgtgtacatcgcgcaatactgtattacgactctcacctatttctttctcacatggtttccggtatatttggttcaggcccgcggcatgtctattcttgaagctgggtttgtcgcttccctgccggcgctgtgcggatttgccggcggcgtccttggaggcattgtgtcagacatcttgctcaaaaaaggccgttcactgacctttgcaagaaaagtgccaatcattgccggcatgctgctgtcttgcagtatgattgtctgcaactacacagattcagcatggctcgtcgttatcattatgtcgctcgcgtttttcggaaaaggcttcggcgcactgggttgggctgtcgtgtcggacacgtctccgaaagaatgtgcaggattaagcggcggtttgttcaacactttcggcaatattgcctcgattacaacaccgattattatcggatacattgttaatgccactggatcttttaatggcgcgcttgtgtttgtcggcgctaacgcgattgcggcgatcctcagctatttgctgctggtcgggccgatcaaacgggtcgtgttaaagaaacaagaacaagaccccgatcaatcgttgcctgtctaatatttatgaaagcgctttataaagggaggaaaatgcatgagttcaccgatacaagagcaggttcaaaaagagaaaagatcgaatattccctcaatttctgaaatgaaggtgattcctgttgcgggacatgacagcatgctgctgaatctaagcggagcacacagcccgttttttacccggaatatcgtaatcttaacggacagcagcggaaatcagggagtcggcgaggtgcctggcggagagcatattcgccgcacactggagctgtcagagccgcttgttgtcggaaaatctatcggtgcgtaccaggcgatattgcaaacggtcagaaagcagtttggcgatcaggacaggggagggcgaggaaaccagacgtttgatttgcgcaccactgtgcacgccgtcaccgcactggaagcggctttgttggatttgcttggaaagtttcttcaggaaccggtcgcggctttgctgggcgaagggaagcagcgtgatgaagtaaaaatgctcggttacctcttttacatcggcgaccgaaatcggacgaccttgccgtatcaaagcgatgagcagtcagattgtgcgtggttccgtctgcgccatgaggaagcgctgacgccggaggccattgtgcgtcttgccgaatccgcacaggagcgctatggctttcaggatttcaaattgaaaggcggggtgctgcggggagaagaggaaatcgaagctgttaccgcattatcgaaacgttttccagaggcaaggatcactcttgatccgaacggggcatggtcattagaggaagctattgcattatgcaaaggaaagcaagatgtgctcgcgtatgcggaagatccatgcggggatgagaatggctactccgctcgtgaagtaatggctgaattccgccgcgcgacagggcttccgactgcgacaaatatgattgcgactgactggcgggaaatgggtcacgcgattcagctccacgcggtcgatataccgctggctgatccgcatttttggacgatgcaagggtcggtgcgggttgcgcaaatgtgccatgattggggtttgacatggggctcgcactccaacaaccactttgatatttccctagcgatgtttacccatgtggcagcagcggctccggggcggatcacggcgattgatacccattggatctggcaggacgggcagcgattaacgaaacagccttttgatatttcttctggctgtgtcaaggtgccggataagcctggactaggcgtcgatattgatatggaacaagtggaaaaagcgcatgagatctaccggaaaatgaatttaggcgcacggaatgacgcgatcccaatgcagttcctgatcagcaactgggaatttgaccggaagcgtccatgtcttgtgcgataagtttgattgtaaatattgtcatatccgctattttgtcttacaattgaacaactgaagggagagttgttcgtgtacgaaggtttagaggatttgaaagtcgatacagtcaatcggaaaacattagccaagcaggtcatcgaacggattgtccatttattatcgagcggacagttgagggccggagacaaattgccgacagaaatggaactgatggacattttgcatgtcagcaggccggtgcttcgggaggcactcagttcacttgaaacgctgggcgtcattacgagaaaaacacgagggggcacatatttcaacgataaaatcggcatgcagccgttttccgtcatgcttgccttggccactgataatcttccggctatcattgaagcgcggatggcgctagaactcggactcgtgacaattgccgcggaaaaaatcaatgaggaagagcttcagcgtttgcagaagacgatcgacgatattgccaacagcactgacaatctttatggtgaagcggataaagagttccatcgaattattgcgttaagcgccaataaccccgtcgttgaagggatgattcagtccctgttgatcacccatgcgaaaattgacagccaaattccgtacagggagagagatgtaacggtcgaatatcacaaaaaaatctacgacgcccttgccaaaagagatccgtacaaagcacattaccacatgtatgagcatctgaaatttgtccgtgacaaaattttaaaaggaatggatgaaaaataatggtgagcaaccgcagttgaaacgtaagagctgcggtttttttaaaaccaatttagaaaacacttactaagttatgaggagtgattttcatatggcgatgaacctcaggaagaaccaagcgcccctttacatcaaagtgcatgaaatagataacaccgcgattattgtaaatgatggaggactgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagggtgccgcagccgcggccgcctcttgaaggctacacgtttgaaggataccgaaatgcggatggcagtgcggggacaaaaaatatcctcggcatcacgacaagtgttcaatgtgttgttggtgttttggattatgcagtcaaacgaataaaagaagagctgctgccgaaatacccaaatgttgatgacgttgtgccgctgcatcatcaatacggatgcggcgtggcgatcaatgcgcccgacgctgtcattccgatccgcacgattcaaaatcttgcgaagcatccgaacttcggcggagaagtaatggtaatcggattgggatgtgaaaagctcctcccggaaagaattgcctccgaaaatgatgatgacattctatcgctccaggatcaccgaggttttgcggcgatgatccaatccattttggaaatggcggaggaacggttaatcaggctgaacagcagaacccgggtgtcatgccctgtttcggatctggttatcggcctgcaatgcggcggcagtgatgcgttttccggcgtgacggcgaaccctgccgtggggtacgcggctgatttattggttcgcgcaggtgcaacggttttgttttctgaagtgacagaggtgcgggatgccattcatttattaacgccgcgggctgtcagtgaagaggtcggacaatcactgatcaaagagatgaagtggtatgacagctatctccggcggggagacgcagaccgaagcgcaaacccgtcaccaggcaataaaaaaggcggattatccaatgtggtggaaaaagcgttaggctcggtagcgaaatcaggcacaagccccatctccggcgtgctcggccctggtgaaagagcagagcaaaaaggcctgctgttcgcggcgacaccggcaagcgattttgtgtgcggcaccctgcagctggctgcgggcatgaatctgcaggtgtttacgacagggaggggaacaccatatggcctggctgctgcaccggtgctgaaagtatcgacgcggcattccttatcagagcattgggctgatttaatcgatatcaatgccggccgaatcgcgacaggagaggccagtatcgaagacgtaggctgggaaatcttcaggacgattttggatgtggcaagcggccgcaaacaaacgtgggctgaccgttggggccttcataatgatttgtgcttgtttaatcctgctccagtgacttgattcatgtttttatagcgggaagatggaatatgttgtaaaatgaaaatcagcgtataggaaacggaggggttacagcatggcattcattagattccgagtgacacgaattcaatagtgaacaactctcgcctgaatgcgagacgggatgaatccgcctatgtatgagcccttacatgattatcaaaaaagagggtggcgtgcctgccctttttttgtaccttcaagcatcccttctctttactgcaggccggagcatgagaaaggggaaatgggatgacaaaccttaacgaaaaacagcttatcactgagattgtcgggcttgcacgcagccaaggtttgacggttcattctgagaacgcgcaattgaatgaaaccggaatggactttcaagttgtatttgccaaggacgacacaggtatgccatgggtgctgcgaaaaccgcggcgaagtgatgttgtggaaagagcatctgcagaaggcataacgcttgcctttctccgcgcgaatttgactgctgatgtgccggattggagaattcatacaccggaattgatcgcttacccaatgttaaaaggaacgccggctgctggaattgacttggaacaaaagcaatatgtatggaatatggatcatcagccgccgtcagacgactttgtccgcacacttgccgacatactggctgaattacatggcacggatcaaatatctgctgggcaatccggaatagaagtgataaggccagaagatttcaggcaaatgacagcagactctatggttgatgtgaagaataagcttggcgtatctacgacgctttgggaaagatggcaaaagtggatagatgatgatgcatactggccgggtttctcttctttgatacacggcgatctccacccgccgcatattcttatcgaccaaaatgaacgtgtcacaggacttctggattggacagaagcgaaggttgccgatccagccaaggattttgttctttatcaaaccattttcggggaaaaagaaactgcccgtttacttgaatactataatcaagcaggcggccggatatgggcaaaaatgcaggaacacatttcagagatgcaggcggcgtatccgatggaaatcgccaagctcgctctgcaaacacagcaggaggaacacatcaatatggcgctggaagcacttggtgtaaaaccgggttaaccaattgacttcatttcaagaaccaagtattataaactttacaaataatagaacggattaacaatcgtgaggaagagcaagtacgcatcagaatggaggttcagagagtcggtggcaggtgtgaaccgatccttccctgatgccgaatgggcttctgaattgctttgctgaacggatagtaggcgatgccgggtttctctccccgttaccaagagaggagtatcgaaacataggttttctgtacttagagtgaacggctgtatagctgttaataaaggtggtaccgcgagaccctcgtcctttgcataggacgggggttttttgtgtttcttaaaggaggtgacggccaatggacgatggctggtggtggcatagcagatgagttagaaaggaggatatcaaatggtcattgcaactgatgatcttgaggtcgcatgtcctaaatgtgaaagagcgggagaaatcgaaggaacaccttgcccggcctgcagcggaaaaggtgttattctgactgctcaaggatatacgcttctggattttatccaaaagcatttgaataagtaaaggagaaaagctgagctgagatgagagcagaagagcagagtaagattcgtgaggccgcagcaggtacgatttttttgctgatcggaacagtttgttttgcgtctaaatcgatttggataaaatgggcataccaaatgggtgctgagccagatgccgtgctgctatacaggcagctgctggctgttccgctgttttggctgatttttttaatataccgtcctccaatgccagacggtaagaaaaaaggagacctatggaaggcttgtggcgcgggagtgttttgtttttttctgtctcccttgcttgattttatcgggctgaaccatgtatccgcaatggttgaacgtatattgctgatgagctatccgttgtttgtgtttggattcaccgtgtgtcgtgaccggaaaaggtcctcaattcaggacctcttcgcagttctggcggtcatgtttgggcttttcttggcgctgggcggctggaatgctgagcttttccaggcgaatatgattggagctgtattcattttgttatcttcggccgtctatgctggttatcttgtcctttccgggcatctcgtccatcaaatcggggggatccgtctcaatgcatacgggatgacagctgctggagctgccatgatgctttacacagggataaaatcggcggctggcatgaatacgccaatggtagcatatccgctttctatgtatggtttgttcgcggtaattgcagtcgtaaccactgtgattccatttgtgctaatgcttgagggcataagacgaatcggggcacagcgagccgccgccatttcaatggcagggcctgtcctgacgattttctatggagctttatttctcggtgaacggcttcgacttattcaagtcattggatgcactgctgtattctttgtcattacgggcatggaatacaggaagctgaaaacaggaaaaaaagaataatttatataaaacacacacgtttttcaattacaataagtgtaattacgtgtgtgttttttgattttgtaaaggttaggtgagaagatgcagcgcatattgcttgtagaagacgaccactcaatcagtgaaatggtggatcattatttaacaaaagaaggctttggaattgtgcatgctttcgacggagaagagggtatccggctgtttcagcagggttcatacgatttggtcctccttgatatcatgctcccgaagctgaacggcatggattttctgaaaatcatccgggaaaaaagtaacgttccggtcttaatgatttcggcaaaagatggagatgtggacaaggcattgggactgggctttggggcggacgattatatcgccaaaccgttttcgatgattgagctgacagccagagtaaaagccgcgatacggcgggcaacgcaatattcggcagaggagccggctgtgaataaggtgatccggattcaccagcttgcgatagatatagacaatgtttccgttttgaaaaacggagaaccgctccagctgacgtcaacagaatggcagctgctgtgcttattcgcatcaaattctaaaaaagtgtttacgaaagaacaaatctaccgttccgtttggaatgaagagtactttgatgatcagaacatcattaacgtacatatgcggcggctcagagaaaagattgaggatgacccctcctcccctcaatatattaaaacgctatggggcatcggttataaattaggagagttttagaatgacagtgctatgggtggccgctgtcatcgctctggcgtgtctgaatgtgattcaattcataatgaaaaagaagcgggacgggaatctggcttacacggctgaccagcttagctacatgctcagccgggattcggcaggacaagttttgcttcctacagacgatcatacgctcaaaggcttgcttgttaacatcaatcttatcgttgagaatcgtcagcagatcagcgcccaatttgccaaaacagagcaatccatgaagcggatgctgaccaatatgtcgcacgacctgaaaacgccgttaacagtcattcttggttatatcgaagcgattcaaagtgatccgaacatgccggacgaagagcgggaaagattgctggagaagctccgccagaaaacaaatgaactcattcagatgatcaactccttttttgatttagcgaaattagaatctgaagataaagagatcccgatcaccaaagtacatatgaatgacatatgcaaacgaaatatcctgcactattatgacgctgttcagtcaaaaggctttcaagcagccatcgatatcccggatacgccggtgtatgcgcaggcgaatgaagaggctctggacagaatcctgcaaaacctattgtccaatgcgattcaatatggcgcggccggcaagttaatcgggctgacgctgtcttatgatgagaggaacatcgccatcaccgtatgggatcgcggaaaagggattagtgaaaccgatcagcagcgggtgtttgagaggctgtacacacttgaagaatccagaaataaagcatttcaaggaagcggcctgggtttaaccatcacaaaacggcttacagaaaaaatgggaggcacgatatccgtccaaagcaagccgtacgaacggactgcatttacgatcacattgaaacgcatgacatattaatcgtaagaatttcttaaggtttgagaaataaaaatgacagggctcgccgctacaatagaaaacaggaaaagagagggaaggagaaacaaagttgacttatatcgtacaaacaaacgggctgaccaaaacgtatcagggcatagaggtcgtatccaatgtcagcatgcatattaaaaaaggtgaaatctacggctttctcggcccgaacggcgcggggaaaacaaccattatgaaaatgctgacgagccttgtcaaaccgacaagcggtgaaatcatcattcttgggaacaagttcacccacacgtcatatgaggtgctggggaacatcggcagcatgattgattatccgattttttatgaaaacctgacagctgaagaaaatttagatctgcattgtgaatatatgggataccacaataaaaaagccatacaagaagtgctggatatggtgaatttaaaacaaatcgacaaaaaacccgtcaaaaccttttccctcgggatgaagcagcgccttggaattgcgcgtgccatcctcacgaagccggacctgctcattttggatgagccggtgaatggtcttgaccctctcggcattaaaaagatcaggcaattgtttcaagtgctgagcaaagagtacgggatgacactgctgatctcaagccacctgctgggtgaaatcgaacaaatcgcggacacaatcggcgtcattcgggacggcaggctgctagaagaggtgtcaatggaagatgtcaggggccagaacactgaatacatcgagcttgtcacgccgaatcagacaagggcctgctttgtgctggagaaagagctgcaattaaccaactttaaaattttaaatgagaaaacaatccgaatttacgaagccgaagcctcacaggctgctatatccaaagcgctgattttaaatgatgtagacattgaatcattgaacagaaaatatacgtcgctggaggattattttatcaaattgatcaacggcaatagcatcagtgcgtaaaggaggagagacacgttgatgaatttgatcagaatcgaattaagaaaaatgaaaatgggctggtatatcagaggtgcccttattgccaacgtgatcattatgggctttatgtggctgatcagttattccgaaaaagccgatggcggggtttcgttccaaagttcggatgaagcattcctcatcatcggcaccttcgtcagagcggtatttatcgtatttggcgctgtgctgatcgtaaaattggtgatttcggaatataaaaacaaaaccattcttgtgatgttcacgtacccgatcagccgtaaaaagctgctcaccgctaagctcatgatcgcgggcggactgacgtttatcacgattttactttcaaatatactcatagccgccggtttcttttggctgaactcgatctgccatttcataccgggagagcttacttccgagatcatttctcaacaggcggtcaaaatggcggttttcgcttttggcgccgctggaaccagtttagttcccatcttttttggaatgcgtaaacactcggttccggcaaccatcatttcgtctgtagtgattgtgatgctcatcagttcaacaagtccgggcttctcgatttcatctgttgtgtatatcccgttatcgttagcggcattcggattgttcttttcctacatggcgatcaggaatgcggacaagcaggatgcgtaaacaaaggcgcccaatatgtataaaaggccgatgctgtcagcaccagcctttctattatgagtctgttcttgtttcaagataatgcttcttgccaatctctttgctcatcatatagaaatggaagcaatattcaccgattgccatgacgatcgcgccgaataaagccgccaatgcaacttcaccgccagtcatccccatagaaagcggcatgcccatcagccaaatcacgagaaaggccaagccaaaatcagccaaagttgcaatcatattattccatttcggcaatacataaagatcgcccagcaaataagaaataacccctaacacaatcgtcattagcagcgtatcaccaaacgtgaaaccaaagcccagaccaagcaccagatacaacacaataatcgtcataatacctttaatagcgagcgctttcacatgtgtcattacaattcctccttttgtcatttgatttgttatgtataattcctcaaatgtaaaaagttaaaccttatttcttttcggaggcgggtgcaaatctgctggggaggggtcaatgatgtgaatccaggaattgaggctgcggcgcttcgacagcggaaatgtgaagcttgtactgcaccggacgctgctttgatgcccaacagcccattatgtttgttgtttttagatgaataaatttaaaaactctcctgtccctccgtcatcacttctgaagtaatgaaatatgatgaaaagagatcaagaggaggtgacgtgatggcggtcgtgaaagcaacgagtgcggatgtcgatttgatggcaaggctgctcagagcggaagcggaaggtgaaggcaagcaggggatgctgcttgtcggcaacgttggaattaatcggctgcgggcgaattgctcagattttaaaggcctccgcaccatcaggcagatgatttatcagccacacgcgtttgaggctgtgactcatggatatttttatcaaagggctcgagatagcgagcgtgcccttgcacgccggtcgattaatggtgaaaggcgctggcctgcaaaatttagtttatggtacttcaggccgcagggggactgtccagcccagtggtataaccagccgtttgtggccagatttaagtcacactgcttttatcagccgacggcggagacgtgtgaaaatgtatataacacattttagagacaggacaccgttcaaattgaacggtgtttttctttgaaaagatgcaatggaaaatattcctgtgagataatcgaagaaaaaagagctgacggagatgacagaatggcaacaattgacctgcaaaagaaaagtgtaaagatcgtactggagaaaaagcagttaacgaaggtgacggctcgtgtcggactggtgcttgatattacgggttcaatgagaacactctacaaaaacgggaccgttcaaaatgtggtggagcggattttggcagtggctgatcagtttgatgataacagtttgctggatgtatgggtgtatgataatgaattttcccgattaaagccagtttcagaaaaggatttttcgggctatgtcgatcgtgaaattttaaataatgaccgcttgcataaattcggcagaaatgatgagccgccagtcatgaaggacgtgctgcgcaaatatattgcggaggaaccgagctcgtatcctgctttcattgtttttatcaatgacgggggctgtaaaaagtcaatcaaaccgataattgaagcttcttctgataaaccggtgttctggcagtttgtcggcatcggaaacggaaactttgattttctcaataaactggatacgttagaagggcgtgtcattgataacacgaacttcctgcatatcgaagagattgaccgcatttctgatgatgagctttatgatgctctgcttgctgaatttccattttggctgaaagaagcgaaggaaaaagggattgtaagagaacaagagcctcctgctgaaaagccgaaaaaaaagggctttttcagcagattgttttcgaaataactgataaagcactgagtcattctgcgaaatggctcggtgtttttgtttttttaagatcatgtgaagaaaaataggccgaatgggcggcttgcaaacgacaggatatgcagaaaacgcgtcattcagccagctttcggcatgtttcagcggcaggcttgtgagggaagacctgtttttaatgttcagcacttacaatcggttcacacttcttcacagtcgtttaacaatgatttcctataatggagacgatcaatgaggagagaggggatcttgaatggcatacgacagtcgttttgatgaatgggtacagaaactgaaagaggaaagctttcaaaacaatacgtttgaccgccgcaaatttattcaaggagcggggaagattgcaggactttctcttggattaacgattgcccagtcggttggggcctttgaagtaaatgctgcgcctaaattctcaagctatccgtttacattaggggtagcgtcaggtgatccgctttctgacagtgtcgtgctttggacacgcctggcaccagatccgctgaatggcgggggaatgccgaagcaagcagtgcctgtcaaatgggaggtcgcaaaggatgagcatttccgcaaaatcgtaagaaaaggcactgaaatggctaaaccgagtcttgcccattccgttcatgtggaagcggacgggcttgagccaaacaaagtgtactattaccgtttcaaaaccggccatgaactaagccctgtcggaaaaacaaaaacactgcctgcccctggcgccaatgtaccgcaaatgacctttgcatttgcttcctgtcagcaatatgagcacggatattatacggcctacaagcatatggcaaaggaaaagcttgatcttgtcttccatctcggtgattacatatatgaatacggcccaaatgaatatgtatcaaaaacaggcaatgtccgcacgcacaacagcgcggaaatcattacgctgcaagactatcggaaccgtcacgctcaataccgttctgacgccaatcttaaagctgcacatgcggcattcccttgggttgtaacctgggatgaccatgaagttgaaaacaactatgccaataaaatacctgaaaaaggacagtcggttgaagcattcgtgctccgccgcgcggcagcataccaggcatactatgaacatatgccgctccgcatttcctctttgccgaatggcccagatatgcagctgtaccggcactttacgtacggaaacctggcttccttcaatgtgcttgatacccgccagtacagggacgaccaagccaataacgacggcaataagccgccttctgatgaatcgcgcaatccgaatcggaccctgcttggaaaagaacaggagcagtggctcttcaacaatttgggcagttcgactgcacactggaatgtgctggcacagcagattttctttgccaagtggaatttcgggacaagcgcaagcccgatctacagcatggattcgtgggacggctacccggctcagcgcgaacgggttatcaatttcattaaaagcaaaaatctgaataatgttgtcgtactgacaggtgatgtacacgcaagctgggcatcgaatttgcatgtcgatttcgagaagacaagttcaaaaatattcggagccgaatttgtcggaacctctatcacttccggagggaacggagcggataagcgggcggatacggaccaaattttaaaagaaaatccgcacatcaagttctttaacgactatcgcggatatgtccgctgtacagtgacgcctcaccagtggaaagccgattatcgggtgatgccgtttgtgaccgagccgggcgcagccatttccacgcgggcttcattcgtttaccagaaagaccaaaccgggttgagaaaggtatcatccacaacaatccaaggcggggtgaagcaatccgatgaggtcgaagaggaccgtttctttgcgcacaacaaagcccacgaaaaacaaatgattaagaagcgggcaaaaatcacgaattaaggagtggaaattatgttttcaaacattggaataccgggcttgattctgatcttcgtcatcgccctcattatttttggcccttccaagctgccggaaatcgggcgtgccgccggacggacactgctggaatttaaaagcgccacaaaatcacttgtgtctggtgatgaaaaagaagagaaatcagctgagctgacagcggtaaagcaggacaaaaacgcgggctgagtgctgatgaggcagacaccgggtctgcctctttttttatgaaagggagggcttttttgaatggataaaaaagaaacccatctgatcgggcatttagaagagcttcgccgccggattatcgtcaccctcgcggcattttttctatttctcatcacggcttttttgttcgtacaggacatttatgactggctgatcagggatttggatggaaagctggctgtgcttgggccgagtgaaatcctctgggtgtatatgatgctttccggcatttgtgccattgcggcttctatccctgttgccgcgtaccagctgtggcgtttcgttgcaccggcactgacgaaaacggagcgcaaggtgacgctcatgtacataccaggtttatttgcgttgtttttggcgggcatctccttcggatactttgtcttgtttccgatcgtgctcagctttttgactcatttatcctccggccactttgaaacgatgtttacggctgaccgctactttaggtttatggtgaatttgagcctgccgttcggcttcttgtttgagatgcccttggtggtgatgtttttaacaaggctgggcatcttaaatccttacagactggccaaagcgagaaagctgtcctattttctgctgattgtcgtgtccatattgattacaccgcctgattttatttctgattttctcgtgatgatcccgcttcttgtcctgtttgaagtgagtgtcaccctatcggcgtttgtctacaaaaagaggctgagggaagaaacagcggcggccgcttagtgcagcgtaccgcccggtgacttcacatcctcatcatattgtgcggccgtaacagcggcgattctcaatgcccggacaatcgtgtccagactgaggctcggcgctgttttgtcgattgtttgctgcggaatgtaaggaatatgaataaaaccgccgcgaatgtgcggggatgtccggctaatgtaatccattaacccgtagaacaaatagttgcatacaaaggttcccgctgtgtaggaaaccgcagctggaatgccgtgttccttcatcttagcagtcattcgtttcacgggaagccctgtccagtaagcggcaggcccgtcttgagaaatctcttcatcaatcggctgctgtccttcgttatcggggatacgcgcatctgcaagattgatcgccacccgttccggtgtaacctgcatccgccctcctgcttggccgacacaaattacgatatccggctgatgtttttgaatggcttggcgcagagtgtccagagcggatctaaagacagtaggaatttgttccgctgtaatgattgcttcttccgtttcgaaaccattaagccgtttcgccgcttcccatgatggattgacggtttctttgtcaaaagggtcaaagccagtgatcagcactttttttctcattctcccatctcctttttcttttattctattgtttatttatgggtttttcatcaaaataatgtaaaggagtgaattataatggagcatttgccgcagcagtatcgtcatttattcccaaccttgcagacgcatacgatgcttgccagctgttctcagagcgctttggcagagcctgtatcaagggcgatccaggattatcatgatagcctgttgtatatggggacgaactggaaagaagcgatcgaaaaaacagagtttgcgagaaacgagtttgcaaagctgatcggggctgaaccggatgaagtggcgattgtgccgtcagtttctgatgcgctggtttctgtagcatcgtccttaactgcatttggaaagaagcacgttgtatatacagatatggattttccggcggtgcctcatgtttggcaggcacactccgattataccgtatccgtcattccatcaatagacggcgtgctgccgcttgaacaatatgaaacgcatatttcggatgaaacagtactgacgtgtgttcctcacgttcattatcgcgacggctatgttcaggatataaaagcgattgccgagatttctcagagaaagggctctttattgtttgtagatgcttatcaatcagccgggcatattcccattgatgtgaaggaatggggcgtagatatgctggcagcaggcacccggaagtatttgctcggcataccgggtgtggcgtttctttatgtgagaaaggagctggctgacgcactgaagccgaatgcatcagcttggttcggcagagagaacggatttgatggggcttatgcgaaaggcgcgcgccgttttcaaacgggcaccccagcttttatcagcgtatacgcagctgcagcggctttatcgctgctgaatcatattggggtttctcatatcagggatcatgtgaaaacgatctgtgccgatgcagttcaatatgccgctgaaaaaggcctgcagctggcggcggcacaaggtggggatcagccgggcatggttgcgatccgggatgagcgggcatcggaaacggcggcgttgctgaagaagaaaaaagtgatttgcgcgacgcgggaaaaagttatccgtctcgctccccatttttataatacgaaggaggaaatgcggcgcgcgattgatgaaatcgcggcgaaaacgatccacaagtaaacataaaaaaagcccctgaacattagtcaggggcttttcatattaatgatctaccttcacgcgcttcataaagaaagcgccaatcaaaccgataatggcaacaatcattgcaaacacaaatgcgtgctgtacacccgctgtcaaagcttgtgggatgactgccggatcggcagggtttttaactgtactcatataatcatgctggcctgcagccataatgctgaccgcaaccgctgttccgatagcgccagccatttgctgcagcgtgttcataatggcggtgccgtctggataaaattcacgcggcagttggtttaaaccgtttgtctgtgcaggcatcatgatcatagaaatcccgatcatcaagcaggtgtgcaggatgataatcagcacagctgttgaagtggtcgttacatttgagaagaaccatagtacaactgtgacaatcacaaatcccggaatgacaagccatttcggcccgtatttatcgaacaagcggcctgtaacaggggacataaatccatttaaaataccgcccggcaagagaacaagaccagatgcaaatgcagtcaggactaagccgccttgcagatacatcggcagaagcagcatagatgacagaatgaccatcatacaaatgaacaccatgatcacacccaaaataaacatcgggtatttgaacgcacggaggttcatcatcggctgcttcattgtcagctggcggattgaaaataggataaggccgacaacgccgacaatcagtgacacaataacagtcgggctggaccatcccccggagccttcacccgcgttgctgaatccgaacacaatgccgccgaagccaatcgtcgacaggatgatagacaatacatcgattttcggctttgtcgtttcagatacattctgcatatatgcgataccgaacacaagcgccagcacaaggaatggaagagagatccagaaaatccagtgccagttgaggtgctccagaaccaatcctgagaaagttgggccgatggcgggcgcgaacataatgacaagaccgatcgttcccattgcggcgccccgtttatgaggcgggaaaatcaccaggattgtgttaaacattaggggcagtaaaagaccggttccaagtgcctgaacgatccttgccgctaataaaaacgagaagctcggcgcaagcgccgcaatgaatgtacctaaaattgaaaagataagtgacacggtaaaaagctgtcttgttgtgaaccactgtaacagcagtcctgaaacaggaacaaggataccgagtacaagcaggtagcccgtcgttaaccattggacggttgccgctgtaatgttcaattccttcataaggtcggttaacgcaatattcagtgctgtttcactgaacatgccgataaaaccggccaacagcaaggaaatcataatcggcatcactttgtattgctgagatgctttagctgttgtttccaaaatcatttcccctctctatcaactgcatgtagtatgtcgtttttttatctcttcagcaggtcaggaatgcagctggagatatgaaggagcggcgtactgttttttgccgtcaaagataaaagaatgccgccttcaatcatcgcgttaaccacagtgctggcttcttttgcacggctctcgctgcagccagtctgccgcagtttttcctcatatacagaggcccattctttgtaggcttcatgacaggcttcgcgcaacggttcgcttttcaatgacgtctcagccgctagcaagcccacaggcaagccttcaatgtcttccgtacatgaaaactggcaggagagctccttcaaaaaggcttgaatgccttccgctggatcggtgcaggcttccatgcagtccgcgattttctgacggatatactccttcatctcattcacggcttcgatcgcaagctgttctttacccccgggaaagtggtagtaaagagagcctttaggcgcgccgctttcctttataatctggttcagccccgtgccgtaatacccttgcagctgaaaaagccgggtagctgccgaaaggattttctcacgggaatctccataactcataacattcccaccttactgaattgcaatcaaaaatatagtgactggtctattatcttgattcaatcatcaattgtcaagaaaaattcattgtatgaaaagacaaaaaaagaaggatatgacaacaaaaaatactgagagaaaagctgactgatcttttgactgaatagataaaatgtacaatgattaatcatcatatggatgtaaggagagaaatagatgaaaaaacaacgaatgctcgtactttttaccgcactattgtttgtttttaccggatgttcacattctcctgaaacaaaagaatccccgaaagaaaaaacgcagacacaaaaagtctcttcggcttctgcctctgaaaaaaaggatctgccaaacactagaattttagcgacaggaggcacgatagctggtgccgatcaatcgaaaacctcaacaactgaatataaagcaggtgttgtcggcgttgaatcactgatcgaggcagttccagaaatgaaggacattgcaaacgtcagcggcgagcagattgttaacgtcggcagcacaaatattgataataaaatattgctgaagctggcgaaacgcatcaaccacttgctcgcttcagatgatgtagacggaatcgtcgtgactcatggaacagatacattggaggaaaccgcttattttttgaatctcaccgtgaaaagtgataaaccggttgttattgtcggttcgatgagaccttccacagccatcagcgctgatgggccttctaacctgtacaatgcagtgaaagtggcaggtgcccctgaggcaaaagggaaagggacgcttgttgttcttaacgaccggattgcctcagcccgatatgtcaccaaaacaaacacaaccacaacagatacatttaaatcagatgaaatgggctttgtcggaacaattgccgatgatatctattttaataatgagattacccgtaagcatacgaaggacacggatttctcggtttctaatcttgatgagctgcctcaggttgacattatctatggataccaaaatgacggaagctacctgtttgacgctgctgtaaaagccggagcaaaggggattgtatttgccggttctgggaacgggtctttatctgacgcagccgaaaaaggggcggacagcgcagtcaaaaaaggcgtcacagtggtgcgctctacccgcacgggaaatggtgtcgtcacaccaaaccaagactatgcggaaaaggacttgctggcatcgaactctttaaacccccaaaaagcacggatgttgctgatgcttgcgcttaccaaaacaaatgatcctcaaaaaatccaagcttatttcaatgagtattgaagaaaagaaggcgaataagccttctttttttggctttttaggaccaataatgacctatgaatcttaaaatttctttaaaaataagccaaaattaccctttacttaattaatttggtaacgtaatatatttggagaatttgttacaaaaaaggatgatattatgaaatttgtaaaaagaaggatcattgcacttgtaacaattttgatgctgtctgttacatcgctgtttgcgttgcagccgtcagcaaaagccgctgaacacaatccagtcgttatggttcacggtattggaggggcatcattcaattttgcgggaattaagagctatctcgtatctcagggctggtcgcgggacaagctgtatgcagttgatttttgggacaagacaggcacaaattataacaatggaccggtattatcacgatttgtgcaaaaggttttagatgaaacgggtgcgaaaaaagtggatattgtcgctcacagtatggggggcgcgaacacactttactacataaaaaatctggacggcggaaataaagttgcaaacgtcgtgacgcttggcggcgcgaaccgtttgacgacaggcaaggcgcttccgggaacagatccaaatcaaaagattttatacacatccatttacagcagtgccgatatgattgtcatgaattacttatcaagattagatggtgctagaaacgttcaaatccatggcgttggacacatcggccttctgtacagcagccaagtcaacagcctgattaaagaagggctgaacggcgggggccagaatacgaattaatgaaaaacaaaaccttgaagaatgctattcttcaaggttattctgctttcagcacaatggttttcgcagccatatcatgaacggtttgttttttcttcgtaaatgcggcagtcaaatagatcaggcgggagaacacatgcacccacgctatcaggtaacggacaatggcttgcgggaaggatatttttttatatgtttcgtccctcacgatttgcagcccgatgatttttttgcccagtgtgcccttccaatttgtcagcggcatcagcaaagggtacacaatcagcatcaatatggcgacaataatgacaccggcggacccatcgccaaacgtaaatccggctgccaaaatcactgctgcggcaatgattacatcaagtaaaagagcgcaggcgcgcagcatgaaaccagctagttccaatagaaacactccttaaaatgttaaataaacacctaatgattgtaaaaaagaagggcctaaagtgggaataggtgataagccttaaatcacaaaagttggtgaaaatgtcataggtaaattggcataatcagccagcttatcacattaccaaattcttttttagcccgaaaccaagccctcagaagttatttttgttaaaatagaaaagttacaacagaattcggagggtttattgtgggaaaagtgaaacgaaatgccccttgcccgtgtggcagcggcaagaaatataaaaaatgctgcggaagtaaagttgtcgacttcccggcggaactagcggcaaaagaagcgaaacaaattcaggaagacttagtggagtatgccttcacagtacatagagaaagcatttcaggctttatcaaccagcatgattttctttctgctatggacagacagacgaaagacatcagcgtatttaacttaggaatctggggaatcttcttccacccgcttgctggtgagaagacaatcttcgaagagtaccttcagaaaaaaggtgattcgatcactcgtccgaaaacgcgtgagatcgtagaatcatggcagagcatgacgcctgctttattgctgctgaaggacctgaaggaaggcatcattcactttgaagatgtgattacggcaaaacaattcgaagtggaaatggacgccagcaatcaagaccttcctccagtgggaagcctgattcttggatacccaatccacgaagcggaaaaagcagaattcttcatgcagttcacgatcttcccggtgaagagaacagaagcgctgatcagcaaggtgaagaaatatgcggatgccgctgtgaaggaaggcaaaacgccggaggacttcatgaagcaggaattcaacaacgttctgttcgcgttgttagctgagaaagatgaagagcagcaagcagagaaagcggaagtaagcactgttgagtgggcaaacgacttggagaaagaaaccgctgcggctattgaagaaggcatgagcggggaagagtatccgactgaattgatcccagctgttattgatatctggaaaacattctgcgagaaaaaatcacctgtcatcagaaagccggaagcttttgctgcggcagttgaatattatgtaaacgcgatttctcttaacggcgcgtctgtttcccaggctaaactggcgaaaaaatacggcgtcagtgcatcaacgatttccagccgttacaaagaaattgaaagcacgctgcaagatgaagcagatcgttttgcccaagcgttatcctcataatggaaaaaaccttgaaaagccaggcttttcaaggtttttttatttctgaaacggaattttgatttctaaccggaagatggggtggcggtaggtaaaatccagcctgccaaaagcgcccttcaccagtttttgaatgatatatgtgcccatgccttcatgagcgccgtttttcgttgagcggccaaacgattgataaattgtatcgagcacttttgggtccatcccgggagtgctgttttcacaggtcagtacataaagtccgctgcgcagtgaagtctccagtttaatctctgctttttctcgggtctccgccgcgctgtcgagcgcgttttctaatatgttgccgaccaagctgacctgatcagcaggcgaaaacggaagggaagaaagcggtgtatgcatatgaagcgaaacactcacattcgaggcgcgggctttttctaaaaaatcataaagcacccctgcaacgtacgcgttctctcctttcaaaaaacggtcatattggctgtattgatccgcccagttttgaatatatgcttgtgtatctgccttgggctgagctgatttgattgcagtgatatgtttcattgtgtcatgattccggcttctgacatcaatcagcatttgattggcgtgctgttcagcttgagtcagcttatcaatttgatcagaaagccttgcctgcaaagcagactgtccgatacggagcccttcacaccctgcaaatatcgcgattacacataataccggcatgatgtctgtgccaatcaacaccactcccaccgacatcacttgaatcaccgcaatccacgcacaaagccctgaggaacagtgtttccacacccgcttcgtattccaaatgtacaatcctgcagcagctgcgcctaaagcagcggcgagccaagaggcggctgtgctgtgtgaaaaagcagcagctccctgataacatatgaaactaaataaaatcagataaagacattgaaaaagggtaatcacgtactaaactcctcaaaaatagtagttttgaaaataatcaagctgctgcttagtgatcatcgcttttttagacgttccctcaaaggaaactgtgaatgaatgcttggtataagcggaaaaatgctttatgtaatgaatgttgataataaaggaacgatgcgaacgaagaaaatctttttcgggcaggtcgcctttaatatcatttaatgtttgatacgtttgcacctcttcggcggttgtcacaatcgtcgtcgaacgtcccgtccgttctgcgaaaataatatccttcttttgcaggacgtgcatttcagacttttgctttatcaatatacgcccattcaaactcgtttccgttttctttttcaagtaccggtcgaaggaagcggccagacggtcggcatagtacggcttcataatataatcatggacgttcaggtcaaaggcgtgaaccgcataaccgccgtggccggtaacaaaaatcacatccacatcaagtgaatgggatttgatcaaatcagcaagctcgtagccagacatatggggcatctcgatatcggcaagcagcagatcaatgtctccgttctttacccgcctgtaggcttccttcgctgaatcggtggaaaagacaatttcgacgtcctgcattctggacacgatcgcttctaacttctctaaatctactcgataatcatctacaagtccgacttttaccattatcattcccctagttacatagaatcatctttattctatcccatttcacgacataaaaagaactcttcgcgacaactttatccaactaatccagcttttcgtatatagtcattactagaaataaagataagggagattgtgacatgattacactgaccgattgcagccgcaggtttcaggataagaaaaaagtagtcaaagcggtgcgagatgtaagcttaacaattgaaaaaggagaagtcgtcggcattctcggagaaaacggtgccggcaaaacgacgatgctgagaatgattgcttccttgcttgaaccatcacagggtgtaatcacagtagacggctttgacacggtcaagcagccggctgaggtcaaacaaagaatcggtgtcttattcggaggagaaaccgggctttacgacaggatgaccgctaaagaaaatctccaatacttcggcaggctgtatgggctgaaccgccacgagatcaaagcaagaatagaagatttatcgaaacggttcggcatgcgcgattatatgaaccggagagtgggcgggttttcgaaaggcatgaggcagaaagtcgccattgccagagcgctgattcacgatccggacatcattttatttgatgagccgacaactgggcttgatattacgtcaagcaacatcttccgcgaatttatacagcagctgaaaagagaacaaaaaacgattcttttctccagccacattatggaggaagtgcaggcgctctgtgacagtgtcatcatgattcacagcggagaggtgatttaccgaggggcgcttgaatcactatacgagagcgagcgcagtgaggatttgaattacatctttatgtctaagcttgtcagggggatttcttaaatgctgagccatatttataaaaaagaaatgatcgacgctttacgcgacagaaaaacgatattactcacaatcttagtgccgatgattatgatgcttggacttgtctttttttatgaaagcatgctgtccgacaaaggggagcagtacacgctggctgtcggccattcgcttccgcccgcactggaaagcaagcttaatgagattgacgaaatcagcgtaaaaacatttgcaaagcctgaagaggcagttgatgaaggaaaagcagatgcctatctgaacgtcccgaaagagttcgactcatatgtcaacagcatgacaccttttaaggttgatgtttacggcaattcaattgatcaagggtcgtcaaatgccatgcagcttgtgcagtctgccttagatcagtacaaaaatgaaattgtgcagcaacgtttaacaaataagcatattgatcaatcggtgatccagccgtttacaattcagcaaaaggaagcggatgaggagaaagggacttccgctattatgctttccgccattctgcccatgctgattctgacttccattgtttccggcgcaatgccgatcgctcttgatatcatggccggtgaaaaggaccgaaagtcaatcgaggcgctgctattaacgccagtcagcagaaacaaagtgctggtcggcaagtggcttgcggtttccacttttggcgtggcttcaggtgtatttgctttggtgtttttgattttgtccaccgtgttatttaccgaaaatttaaaaacggccttccagctgggagatcatatgtggagtgtaatcggcgcttcagccttaatcattgtgctctctgcattgctgatatctgcgatggagcttttcatcagcatcatgtccagctcggtaaaagaagcgcaaagttatatgtctctcgtcgtctttctgcctgtgttcccgatgtttttcatcttcagcaaggcaccgaaccaatttgacttatcatactttctcatcccgtttctgaacctgcatgcgttatttaaacagcttttattcgggatggttgacccggctaccattttgtctacgtcaggaaccatcgccgtgctcatcgccatcttctttttactagccagagcctgcttcctgaaagacaaatgggttcttccaaaataaacttgcgaaaggagaaatacactttctcctttttgtatatcctgaaaaaagaaggaaaatagaaaaaggatatctaatacaaaaagtgaccctgcactatttttcatcaaaattggtttcaaaggagaaggaacaatggatcaaacacgtacactcggcaaaacgaagctgaaggtgaagcggatcggattcggcgcgaatgcggtcggcgggcataatctatttccaaatctaaatgatgaaacagggaaggatttagtgcgcacggcattggatggcggcgtcaattttatcgataccgcctttatatatggattggggcgatctgaagaattaatcggcgaagtcgtacaggaacgcggcgtgcggaatgagctcatcatcgccaccaaaggagctcataaagaagtggacggcagcattgaattagacaatagccgggagtttcttcgcagcgaggtggagaagagcctgaagcggctgaaaacagattacattgatttgtattatgttcactttccggatggaaaaacacctctcgctgaagtggcgggcactttgaaagagctgaaggatgaggggaaaatcaaagcgatcggcgcttcgaacctcgattatcagcaattgcaggattttaatgctgacggctatttggaggtcttccaggccgaatattctctcatacagcgtgatgccgagaaagagcttcttccatactgtgaaaaacaaggcatctcctttattccttactttccgcttgcgtccggactgctgacaggaaaattcacgcgagacacagtctttgatgatttcagaaaggataaacctcaatttcagggtgaaacgtttatccacaatctcaaaaaagtagataagctgaaagcagtagcggaggaaaaacaagtggatacggcacatgtcgccttggcgtggctgttaacgagaccggcgattgatgccattattccaggagctaaacgacctgagcaactacaggataacctgaaaaccttgaacattgaactcaccgaagacgaagtgaatttcatcagcgacatttttaaataaaaaggaaatagccgtcatggctatttccttttggtgttttattctttgatgaatgcttcgactaattctgctgctctgtaatcatccatatcaagctgccattggtcgatgtcatttttcttcattttcacttcaactgttttttcagatgaagcaggtccaagctttttaaattcctcagggtagacttgaagcgcgtatttcactgcctcttcatagctggcactagagtttttactgtagtagtctttcactttgtcttcgatacggtctgaaagagaagatgcatctacaggtttaactgttgcttcaacaattgcttcgtctttagagattgaagtcgtttttgcttgaatggaagagtttttgcttaatccctctttaatgccgttcacgatattatcaagcgctttgctgtccgcatatgtgctggaaaggccggaagctgagagataaccgtctttggctgattcattgaaatcatttacaatttcatttttgttagcgccggtgattttttcgaaatcggcgttatctttgccgaaaagaaggacatcaacataagctgataacgcttttgcagaatcttggagcttatctgccgtcgccaggatttttttgtcttttccgtcaattttaaaagtaactgattttggctttttatcaccgtaagattccggcgtatagttaagctcgtattgcttgcctttatctacaacgaagaaaagatttccttcaacggatttgtcagcgttaatcgtgctgccctgaagcttttcgctatagtcttcagggtctgtgtcagacattttggtatcaccttgatacaatgtgaaatccatactgtctacattcagcgggtcttttcctgtgtttttcaccgcgacattgacttttaacacaagctggtcatctgaagtggacttatcatatttagacggaagtgtgtaagagacatccttgattttgacttgagctatatctgagcttttttctgtttctgattctttcttctccgcgcttgttttgctgccggaacaagcagctgtaaacatcatcagcagaagaattaggaaaacagcgtacgtttttttctgaaacattcatttttcctcctcaaatggtttaggaaaggggagtcttttgtctttgagaaatggatctttttgaatggattagcatcatataaccaaaaaaatcagttcttttctcacggttttcaccggattttctggaaactccgccctcctttgtcatgaatggacctataaaaagttacaacggaattaattttaagattattagcttttatattgaataggttcatcatcctatttttggtgaaaaatgttctggtaaaactggtaaactcagaaaactgtgtattttagactattactttttgattagttggagggaacttaagaaggatgaaaggggctgcctttgtgaagaaagagggactgaaacaaaaagcactggaaatcggccgggtgccgacacacttaaaactggaaattgaagattatggcggtgatgacaaaagagcctatttttgttggagagatcctcaggatgagaatatcggcattatcgtggaacttggaccggacggggagctggaatccctttcccgtgatattgagcctgaaagcggagaaaggctgtctgaggagaaactagaggatatcatgcgccaatttgtcgagactcatcatccgggggcactctctgcctttgttcgtgaagaaaatgaccgtgcatacggcgataaagtgagattttcatatgttcaaatggaggctgggcttcctctccccatgagcggatttatggctgatgtttccttatcaggtgagatcgtttacttccgctattacggcgaagcaggcagcatcatcaagccaaagagggtcgcggatgttgaagaggcacttgcctttatcaagaaggacgtagagttcgaccttttgtttgaggttctccatcgttctgtttacaaaaatggagatgatcagccacatttggtgtatgagcctgaatgtagggcgattaccgtacctgcggatttggttcaagaagaacaaggaggagttgatgatgacgatgattacagggagccggagagctttcctctccctttattcgagagcatccgcgaaaaggccgatcctgacagcatgattggtattgaaaatgggtttgtcaaagagcgggaagcggatttgggagatgggagaatcggaatcgtttggcggaatccggaccttgtgtatcagccggcggataaaagcatggacagctggtttaagggacggactcatcaagtgctgaaaaccatctataacaaagaaaccggaaaactcgaaggcgtcatgtcatttatggagaaaaaagggccgctaacagtaactttggcagagtgcgaaaaaatcgcgcttcgctttctgtttgctttatttccgaatgccgatcaatattttaggatcagatacgatgaaaaggatgaagaagaaaacgcagtcactgtttttacatttgaaacgcattgtcacggagttccgctccgatttgggcagatcaaaatttgtgtcagccgccagacagggtatatcaccgtttatatgggaccggatattgacccaaatgagctggcaaccattgatcctgtgccggccatttcagttgaacaagccaaggctatcttttggcagcattttaaagttgagcttggctgggaaagagagtacggagatgatgaagaacacagctaccggctcgtctataagccggtgtatccgcgttttatcgatgcacatacaggagagcctgtcttcagctcatggtaaaacagccaaaagtcacgcaattgcctcaggtatagaagagagtacgtgatgaaagtaacagaaagaatctcgaaaaacaatgacaataatagaaaaggacctttcttcactttaaaagaagaaaggtctttttatataataaacaggattctctttgtcgtagactctttgaaagggatgacttcattggttaataaacagctgaaaaagaaggcgcaggagatcggaaatgtaccgacgcattatgagcttgagatagaagattacgaccaaaagcaaaagaagaacgggcaggcatattttatctggaaggaccctaaagatccggaaaggcacattacagttgaacttagaaatgacggcgctttgctcaccttttcaacaactgtccgctccgagacagacaaaaaacttccagatgctgagctgaagctgacggctcttcagtttgccgctgcccatcatcccggcacatttatgaattttcattttcaaggcaaggaagaacgggggcagcacatccggtttgtctataccaaaatggagctggggcttccgattcccaattcaggctttttaattgatatgacacgcagcggtcagattgtccactttctatattacggggaagggcataaagccgaagttccgacggaatttgtagcaaaagagaaggttgtgtcccattacttaaacacaatgtcttttgagctgatgtacgatgtcattgatggcgaacaggaaccaaggcttgtttatgaaccgattctcccgggatacagctatcccgcagatgtagacgaaattgtgcccgaccagcatatcgcagatgaaagaatagaaaacacggcgccactgccgccgcttcagaacaaggaagaagttgatatatttgccttgctgggttttacctctgatatgcagaaagtcagtgaaagagactttggggaacaaattggaagcacgtggcgcaggggcgctgcgccggagcgtaaggatttaagcataggaagctattttgaaacgagaaataaaaacacaatcaaaatgaagacggataaaagaaccggaaaattaaaagcagcgctttcttttatggagcggcagaacaaccgccaatgctccacggaagaatgccaagagatagcgcttcaatttttgtatgccctctatccgagagcggctgagtttttcagggtgaatcccgtccgaattgatgaaagagggagagtccgcaaccatttttctgtctggtataaaggagtgccgctgcggttcggcgctgcccgcatcattgtcaatccggaaactgggttgattgacgcttttatggcgcctgatattgaacctgaacaattggaagcgataaatcacaggccggatgtttccgctgaagaagcgagagaagcgtttttagccgcttttgatgtgaagctggaatggcagcctgactttactgcaggcagtgaccagcactacaaacttgtctataagccggtttacccttcctatattgatgcgcacataaggaaaaagaaaaggctgtgaggggtgtctagttaggaatcatctccaagtgggggtagtccttgaatcgtttccaatccccgccccattcaaaaccgagtgtcttagcgatctcgacaacctccagccaatctgattttccgttttgattgccgtcatattccatatcccatatgatgcttccatcctttttttgaagggcgaaatcaatcgctaaaccatagttatgatacgattcccctcctcttgcataggtgacaatattccctttttttgtacgtccctgtttatataattcatcttgttccttaaaggacctgaatccttcagtaatgacgacggtaatgcctttattcgctgcagcggctttgagtgcatcggcattctgcttcacaatcggatgaagatccgaggggacaggcatgtcctgcaaggcgttttgagaatgccattcatgccgaatataactaaaacaaagatctagaagaaatagaatacataagataacaaatatttttgcgggtaacttcatatcggtctcactttctcaagatgtgctgaatgttaacgcttttaagtgattgactctctctaaaagcgaacagctatgataaaatataacataaatagtagcaggaggaaggaggcagaccgatgagagcaaagattccatcagaagaagtagcagtaaagctgaatgaatggtacaagctcattcgcgcatttgaagcagatcaagcagaagcgttaaagcaggagattgaatacgatttagaagatatggaagagaaccaggacttgcttttatatttttctttgatggaattccggcatcgaatcatgcttgataagctgatgccggtgaaagacagcgacaccaagcctccattctctgatatgctgaacgaaattgaaagcaatcagcaaaaactcacgggcttattggaatattacttttattatttcagaggaatgtacgaattcaagcagaaaaatttcatattagcgattgaccattataaacatgccgaggaaaagctcgagtatgtcgaggatgagatcgaaaaagctgagtttctttttaaagtcgcagaagtgtattatcacatcaaacaaacgtatttttccatgaattatgcgagccaggcgcttgatatctatacgaaatatgaactgtacggtcgccgccgggttcagtgtgaatttatcatcgccggaaatttgaccgatgtgtatcatcatgaaaaagcactgacccacttgtgcagcgctttagatcatgccaggcagcttgaagaagcgtacatgatcgccgctgcctattataatgtcggacactgtaagtacagtctgggtgattacaaagaagcggagggctatttcaaaacagccgccgccatttttgaggagcacaactttcagcaagctgttcaagctgtattttcactgacccatatctactgtaaagagggaaaatacgacaaagcagtagaggcgtatgaccgcgggataaagagcgcggctgaatgggaggatgacatgtacttgacgaaattccgcctcattcatgagctgtatcttggaaacggtgacctgaacgtgcttacagaatgctttgacctgctggaatccaggcagcttcttgcagacgccgaagatctgctgcatgatacagcggaacgtttcaatcagctggaacattacgagtccgccgctttcttttaccgcaggctgatgaatattaaaaagaagcttgccgagcagcgttttcaataggaaatggcagagaactacaggttctctgcttttttttgtgctgttttcaactcggaaaaacagggtattttccactgcatagtgagaaatcagaggaggatatcaagtatgtacaaagatttaaccggaaaaacagcgattgtgacagggtcttcaaaaggaatcgggaaagccattgcggaacggttcggacaggagaaaatgaatgttgttgtaaactaccacagcgacccgtctggagccgatgaaaccctggaaatcattaagcagaacggagggaaagccgtcgcagttgaggcggacgtgtcaaaagaagaggggattcaggcgctcttggacacagctttagagcatttcggcacgctcgatgtgatggtaaacaactctggttttaacggcgttgaggcgatgccgcatgagatgagtcttgaagattggcagagagtgattgatgtcaatgttaccggaacctttctgggagcgaaagcagcacttaaccacatgatgaaaaacaatatcaagggcaatgtgctgaatatctcaagtgttcatcagcagattccgcgccctgtcaacgttcagtattccacatccaaaggcggcatcaagatgatgacggaaacgctggcgctcaattatgcggataagggaatccgcgtcaatgcgatagcgcccggcaccattgccacagaatcaaatgttgatacgaaaaaggaagagagcaggcaaaaacaattgaaaaaaatcccgatgaaggccttcggaaagcctgaagaagtggcggcagcagcagcttggctcgtatctgaggaagcaagctatgtgaccggcgcaacacttttcgtcgacggcggaatgacactttatccatctcagcttgaatagaagacaaaacagggggattgcgggatgaaaacggactggtggaaggatgcagtggtgtaccaaatttacccgagaagctttcaggacagcaatggagacggaattggggacttgagggggattatttcccgtcttgactacataaaggaactcggggcagatgtgatttggatttgcccgatctatccttctccgaatgttgattacgggtatgatgtgacaaaccataaggcgattatggattcttacggaacaatggacgattttcacgagctgctggaccaggtgcatcagcgggggttaaagctggtgatggactttgtgttaaatcacacctcggtcgagcatccgtggtttaaagaagcggagctggacaaaaacagcaaataccgcagctattattattggcgtcccggcacaaagaacggcccgccgacagactggctctcagactatggctgcccggtctggcaatacgaggagcacaccggagaatactatctccatatgaatgccgtcaaacaagctgatttaaactgggaaaatcctgaagttcgccaggcggtgtatgacatgatgaaattttggctcgataaaggggtcgacggtttgcgaattgatcagctccatctcatttctaagaaagaatatcttccttcgtatgaggactatatcaatcagcaggcagagccgaagccctttcagccaaatggcgaacgaatccatgactatttaaaagaaatgacagatgaagtgttttcccaatatgatgtcatgtctgtcggagaggtcggcagtgtcacaccggaagaaggcctgaaatatacgggaacagataagcatgagctgaatatgatttttcactttcagcatatggagcttgatcagcagcccggaaaagaacattgggatttgaagccccttgagctttctgatttaaaatcggttttgacaaaatggcaaaagaagcttgagcatcaaggctggaatacattgttttggtgcaaccatgaccagccccggattgtgtccagattcggagacgatggggaataccgcaaagcatcagcgaaaatgctggcagccgtactttattttatgaagggcacgccgtatatttatcagggagaagaaatcgggatgacaaacgcgccgttcacccggattgaagactacaaagatatccaaacgatcaatatgtatcataaacgggtgtttgaaaaaggctatgatccaaatgatgtgatgagatcgatcttagccaaaagccgggatcacgcccggaccccgatgcagtggaacagcggcaaaaatgccggatttactgacggcacgccttggctgaaggtcaatccgaacttcaccgcaatcaatgtggaggaagcgcagggagatcctgattctgtcttaaactattacaaaaagctgatcagcctgagaaagcagtacgctgacctcatgaaagggagctttgatcttttgcttccggatgatccgcagttgtttgtatacatgagagaaaacagtaaacagcagcttttgtcggtcaataatttttcaaaagagcaggctgtttttcagtggcccaagaactgcggcaaagctcaggcctctctgcttctcagcaattataacaacgatgatcttgctgacgaaatggtgttccggccttatgagagcagggtctatcttctggacaaaacaaactaatgattgaagtagcccggcatttttagccgggtttttttagtacatatattcgctctgcaggcgggaagaataaatgaaaatgaaatttattcttgcaaaacgtaatgacttcggtttattatgatataggattacaaaatcgttatcattttgatttaaagtttctgaaaaagaggggatatacgatatgtttaaaaaatggagcggtttgtttgtgattgcagcgtgctttttattggttgcagcatgcggcaactcatcaacaaaagggtcggcggattcaaaggatgataaactgcacgttgtcacaacgttctacccgatgtatgaattcacaaaacaaattgtaaaagacaaaggcgatgtggatctgttaatcccatcttccgttgaaccgcatgattgggaaccgacgccgaaagacattgccaacattcaggatgctgatttgttcgtttataatagtgaatacatggagacatgggttccgtcagctgaaaaaagcatgggccaaggccatgccgttttcgttaatgcaagcaaaggcattgatttaatggaaggctctgaagaagaacacgaagagcatgatcatggggagcatgagcacagtcatgcaatggaccctcacgtatggctcagccctgttctggcacagaaggaagttaaaaatattacagcgcaaatcgtgaagcaggacccggataacaaagaatactatgagaaaaatagtaaagaatatattgcaaaactgcaggatcttgataaactatatcgtacaaccgcaaaaaaagcggagaaaaaagaatttatcacgcagcatacagcttttggctatctggcaaaagaatacggcttgaagcaggttccgattgcagggctttcacctgaccaagaaccgagcgcagccagcttggcaaagctgaaaacatatgccaaagaacataatgtaaaagtcatttactttgaagaaattgcatcctcaaaggtcgcagatacgctcgccagtgaaatcggcgcgaagacagaagtgctgaatacactggaaggcttgagcaaagaagaacaggataaaggtttagggtatatcgacattatgaaacaaaacctcgatgccctgaaagattcactattggttaaatcataagatagtgtgcgccggagggtgcacactatttctttgtgagaaaggaagattaacatgaatctcgtctcattgaaagatatcgttttcggctattcccatacgcctgttttagataaagtatcacttgatattgaaagcggtgagttcgtcggcatcactggaccaaacggcgcctctaaatcgacgctcataaaggtaatgctcggcatgctgaaaccgtgggaaggcacagtgacgatcagtaaaaggaatacagaagggaaacgcctgaccatagggtacgtcccgcagcaaatttcttcatttaatgccggctttccgagcacggtgctggagcttgttcagtcaggccgctatacaaaagggaaatggtttaaacgtttaaatgaagaagatcatcttgaagtagaaaaagcactgaaaatggtggaaatgtgggagctccgtcatcgtaaaatcggtgatttatcaggcggacagaaacagaaaatctgtatcgccagaatgctcgccagcaacccggatctgctgatgctggacgaaccgacgacagctgttgattacgacagcagaaaaggattttacgaatttatgcatcaccttgtgaaaaatcacaaccgcacagttgtgatggttactcacgaacaaaacgaagtacagcaatttttagataaagtgattcgattagagagaggagaaaaaggcggatggaaatgtttgacttggaattcatgcgacgagcttttctagcaggcggcatgatcgccgtcatggctccgatactaggagtgtatctcgttctcagaagacaggccttaatggctgacacactttcacatatctcattgtcaggtgttgccatcggcttttttctcagcaccaatataaccgcagcaagcatagtcgtcgtgaccatcggcgcgatcggaattgaatacatgcggcgggcgtatcggacttattcagaagtgtccattgccatcttaatggcagctggtttgtccttcgcgatgtttttaatcagcctttccaaaggcacagccaatatgagcatcgatcaatacctatttggatcgcttgtgacagtaaaccagcagcaggtctatattatcagtattatcacactgctgatcatgctttattttatcgtactgagaaggccgctctacctgctgacgtttgatgaagcaacagccaaaacatcgggaatcaatacaaacgttctctcgttgtcattcagtattgtcacaggccttgcgatttcagtcattattccgatcatcggggtccttcttgtatcggccctgctcgtattgccggcagccttcgccatcagaattgcaaaaggctttaacatggttttcattacagccatactcatttcattattcagcgtatttacgggactgacatcatcctatcagctcgggacgccgccaggtccgtctattaccctgctattgatcgttttgctattaatcggatttgcagttcagggagtttggacgtttatcaaaaaagaagctcagcgcaaaaaaagaagccgataacatgaaaagcagttttccctagggaaaactgctttttttatagaaacaatctggcaaggcgctcatacgattcttttttcgcctcaaaatcaaacacattgcacagaaccatgatttcatttgtttcgtagcggcctgtgaggtctaacagctgttgtttgacagtggttggagaaccgatcaccatccgctttctgttttcttctatgagttttttatcggacgctgtgtagggataggcttttgcctcctcgatgcttggcacgcggctgtccaagccttttccgacgcgaagaagccacaaatcctggcttaatgcgagttcttctgcctcttcatctgtttttgcgcaaatgacaaaaatcgtaaacagtgcggatggattcgaaaaatgggctgagggccgaaagctttcccggtagatgcggaatgcattttctcctcgctcgggattaatgaaatgcccaaatacatatccaatcccctggtgcgccgcgcgtcttgcgctgttttcaccaagaccgagcacccatagctcgggtgccgtaccaataaggggcgccgctttgattccggcatacggatggtcgggaggaagggaatctgttagaaaataagagacatcctgcagctgtctgttaaattcggttaagctttttttcaccccgtccgttaatgcaagcctggtttttgtcgtgccgccgggggaacggccgacgccgaggtcaatccggtttggatacagggcctcaagctggcgaaaggtttcagccactttaaatgggctgtattggggcagaagcacgccgcctgatccgacacgaatggtgtttgtctgtgctgcgatgcgggcgatcatgatttcaggcgctgtgcttgccagtcctttcgtgctgtggtgctcggcaaaccaataccgcttatagccccactgttcgcttaattgagcaagctcaaccgaatgctgaagagttgtcacagggctctctcctttagaaacaggtgcctgatcaagtatgcttaaatgaatcaaaaggccgcttcctttctgtctgtttttagatggtgacacaagaataggcaaaatgacttgcccgcgtcaaatggtttgtttaagaagcgcactttatagcatttgcaaatcatatatcaaatatggaagttttttttcgaggtttttcgtcaattattcttaacttttacgaaactttgatataataacaaacgtatatattagtaatttacggcttattttccttgtgagcgtaaaaataaatgtgactatcttcacatttcgatgagtaggagtgaatcgtgtggcaatttctttagaaaaaggtcaacgaattgatttaacaaaaggaaaagccggtctgtcaaaattgatggtcggtctcggctgggacccagtgtcctcaggcggaggattcttcagcaaactgcttggcggaggcggtccgaatatcgactgtgacgcttcagtgctgatgctggaaaacggaaaattcaccgataagaaaaacctgatttatttcggcaacctgaaaagccgctgcggcggtgtacagcatacaggcgacaacctgacgggtgacggtgcaggcgatgacgagcaaattatgatagatttagataaagtgcctgcaaacattgataagcttgtatttgtagtgaacatttacgattgtgtcagaagaaaacaagatttcggcatgattcaaaatgcgtttatccgcgtagttgatcaatctaatcacgaggaaatgctcaagtacaatttgagagacaattacgccggcagaacaagcctgattacagcagaaatctaccgcagcggcagtgagtggaagtttgcggcgatcggtgaaggcacaaacgatacgagattagaagatattatcagccgatacgtataaaagaaaaggagtggatgaaacatgacaatttcattggcaaaaggacaaaaagtagatttaacaaaaacaaatccgggtctttcaaaggttgttgtcggtttaggctgggatacgaacaagtatgacggcggacacgactttgatcttgactcaagtgtgtttctgttagacgccgcaggcaaatgcgcgtcaccaaacgactttattttctacaaccagcttgaaggcggcaacggttcagtcgttcattcaggcgacaacctgactggtgctggcgaaggcgacgatgagaatgtaaaagtaaatctcagcgctgtaccggcaaacattgataaaatctcatttgttattaccattcacgatgcagaagcgcgcagccaaaactttggacaagtatcaaacgcgtttgtccgcatcgtaaatgaagaaacaaatgaagagctcatccgttacgatcttgcagaagatttctctattgaaacggcaatcattgcaggggagctttacagacataacggcgagtggaaattctccgcaatcggctcaggctaccaaggcggccttgcccgcattgcaacagactacggtttgcaagtcggttaagacaaatacgaagagcagaaaggagagaggcagtatggccattcaattatcaaaaggacagcgcattgatttaacaaaaacaaatccgggactgacaaaagcggtgatcggcttaggctgggatacaaacaagtactccggcggacacgattttgacctggatgcttcggcctttttagttgatgcgcatgataactgcgtaaatgatctcgatttcgtcttctataataaccttgaacatccgagcggcggtgtcatccatacgggtgacaaccgcacgggtgagggcgacggagatgatgagcagattatcgttgatttctcaaaaatcccggctcacattgagaaaatcggcatcacagtgaccattcacgacgctgaagcacgcagccaaaactttggacaagtttccaatgcgtttgtccgcgttgtggatgaagaaacgcagaatgagcttcttcgcttcgatttgggagaagacttctccattgaaacagctgttgtcgtttgtgagctttacagacacggcggcgagtggaaattcaatgcgatcggcagcggattttccggcgggctggctgcattgtgccggaattacggtttgcaagtgtaagcgagtgacaaatagagaagtcaccgtttcaaattaataggaggaaaaaacttggactttttacatcatattttgtctacgtatgcttcatttttcgattggaaaatgtggggggaagttctgactgatcctgtttcttggggtttgatcggttcccttgttgttctggaaggccttttatcggccgataacgcgctagttcttgcggtcatggttaaacacctgccggaaaaacagcggaaaaaagcgttaacgtatggtttgtttggagcttatattttcaggtttattttcatcgggctcggtatgcttctcattaaattctggtggatcaaggtgcttggcgcgctttacctggcttggctcgtcattaagcacttctggattggcgaaaaagaagaggaagcggacggcatcaagaaaaactcttggatggtccgcacgttcgggatcttctgggcgactgtcatttcagtagaattaatggatcttgccttctctgtggacagcatcctggccgcgtttgcagtatctgaaaaagtatgggtgcttctgattggcggtatgcttggtattttaatgatgcgtacagtggcaaaagtattccttgtgctgattgataaaattcctgagctggaaaacacagcattcgtcttaatcggcattatcgcgctgaaaatggcggggagcgctttccattacgaaatgccgcactctgtattcttcattatcattatcgctgcatttgcggtaacattgatcattcactacatcaataaacaaaagcaggtgcgcgaacaaacagccgcttcaaaagaagaataaaacaaaacaaggagggaggttcaatgtccttccttttttgttaccgaaatatcgttcaatgacaaaccggaaaggaggatatgatgagacaagaagaactaaccattcataaagcacttccggctgatggcgattggaaaagcctgctgtttcagccattgccggagcgggatcactatgaaactgcacaaggcctttctttttctcgtcttgccggtcagatattgggcacgcctattgatgagacggattactataacgagctgtatgagctgtctgtaaacgaccgcataacgattttgagtgaaacgcttgataaaacaatcgaaccggaaacatttcaaaagcttcagcatattcattccatcaatcagaaagaaaaagggctgtcagtcagccgctttgttgcctttctggacggggaaaagctgattgcgaagcactcaaatcccctgatgcaccgccatttaagaaaagcgctgatgacgcttttacatacctttgcggacagtcatgaaaaggggctgaatcatcctgattttcgcagagtgctgcttgatgtctcgaagttttccttaaaccatctgaacccttggctggaaaaaaccgatatagagcgggagatgccgaaggttgtttggtatggagatgcgacgaaaagccagctctatttcttatattatctgatgctggtcggctgtgatgtactgctgttccatccggcgggaacggatcagctggcgcttgtcgacccgaagcaggagctcggttttacggaaaagctcccggatgtttcggagcttcagccgtttccgaaagaaaaaccagaccggaaatcaacagtggcttaccgctcaacaaaggaaattgaacatgtgctgaatcacgaggaatccatgctgtataagccgtggcagttcagagatcacacaccggtgtccgttacgctgaaaacgacctatgatgaattgtttttaatcacgaaagaacgcgcctttattcggccgaatttcaaagctgataaacattccattgagattccgaatgtattcgccaaaattatgggcgtgtcgaaagacaataaggaatattggaacaggcttcatactctagcggattatcaggaaacagaaatggtcagaagctttccatttacagaagaaataaagtcgaactatcaatttcactacagccacgcacttgatcaagaagggaacattgatccggacaagctgatggcaagcaatgtgtggcagtacaaacagctgccggcgggcgttcagactgccattgccaaaacgatttcgagaatgtgcaggcacccgcggcttaaggctttgcatcaggaacaagtcaaggatgttcaaatctatttgtttaaacaaacaacaaacctgcctgctaatttgctgaaattgattcaaatgttcgactatgcgcaaaccgttccgaaacttgttttatatcatacggaaatgagcggcggactcacgcgttcggatgctgccgccctgctgttcttgaatgaaatcggaatcgatatcatcatttataatccgcccggacaccaagatattgagcagtttattgaagatgaccagtatgatatccactggctggatgacatggtgtttcagcaggactacaaagagccttcgcttgtgaaaaggctcttcagaaccattacccaaaaataaggagagaagaaaagcatgacaacagaaaatcaaaatccgcttgttctcgataaaaatgaagagatttcccagcaaaaagctgacgatatccgtcttcagctccgtcaggaaccagaagtgaagcggcttgctcaacaaattgatgtcaaaaaccaaatggagctgcttgagtacggcaaggagccagccattgaaatatccaagttctctgaccgcatcttagggatgatgaaaacaacaagcgtgacagactccggcacaatgctgactcagcttgggaaaatcatggaccgcttcgacaaaaatgattttgatgagccaaagggattaatggcgaagattttcaaacgcggcggcagcatgattgaaaaaatctttaaaaagtatcagacacttggcggagagattgaaaaaatccacgttgagatttcaaaatacaaagatgagatgacgaagacgaactacacgctcgatgaaatgtatgaaaacaatatcaaatactatatggagcttgaaaaatacgtcgttgccgggcagatgaaactggaagagatgcagtcgatccttccttcatatgaggaaaaagcggcaagcgggaaccagctggcgcaaatgcagctcgatacgttgcgcaacggcattcaggcgcttgaggaacgggtgtatgatctggacatggcacggatggtggcgcttcaaactgcacctcaaatccgtctcctgcagcgaggaaatgcaaagctgatcgggaaaatcaactccgcgtttatcattaccattccgattttcaaaaacggcattattcaggctgttacggtaaagcggcaaaagcttgtggctgattccatgagcgagcttgaccgccggacaaacgagatgctgaaacgaaatgctgaaaacatctcgagccaaagtgttgaaattgcgagaatggccggcagaccgagcatagatattgaaacgattgaatcgtcttggaacacgattgtcagcggcatgcaggaaacaaaacaaatcgaagaagaaaacaagcgcctccgcgaagacggcgcgagacgaattgcacagcttcaggataatattaaaaaagcagcattgcagcaataataaaaaccccgcttgtggaacataagcggggtttttcaattacatcatttagttaatgacaatgtgtaaagacaggtgtaaacttaaacggtaatcattttgcatatcagaggtgttggcaatgggaaaacaacagcctatatcccagcgtaaactgctgggcgtcgccggtttggggtggctgtttgatgcaatggatgtcggaatattatcgtttattatcgccgcgctccatgtagagtggaatctgtcgcccgaggaaatgaaatggatcggaagcgtcaattccatcggcatggctgcgggtgcgtttttgtttggtttgcttgctgatcgaatcggccgcaaaaaagtgttcatcatcacccttttatgcttttccatcggaagcggcatttccgcttttgtgacgagcttatcggcatttctaatccttcgtttcgtgattggtatgggacttggcggcgagcttccagtcgcttcaacactcgtttcggaagcggttgtgcctgaaaagcggggcagagtgattgtgcttttggaaagcttttgggccgtgggctggctcgcagcggccttgatttcttactttgtgataccaagcttcggctggcaggctgcccttctgttaactgcgctgactgctttttatgcgctgtacctgcggacgagtctgcctgattcgccgaaatatgaatcgctttctgccaaaaagaggtcggtgtgggagaatgtaaaaagcgtctgggcaagacagtatatacggccgacggtgatgctgtcgatcgtttggttctgtgtggtgttttcttattacggcatgttcctatggctcccgagtgtcatgctgctgaaaggcttcagcatgattcaaagctttgaatatgtcctgctgatgacgcttgctcagctaccgggctatttctctgccgcatggctgattgaaaaagcgggccggaagtggatactcgtcatttacttgattggcacagcaggaagcgcctatttcttcggaacggcggattccttaagtcttctgcttacggctggaatgctgttatcgtttttcaatctcggtgcatggggcgtgctgtatgcttataccccggagcaatacccgactgcgattcgagcaacaggttcaggaacgacagcagcgtttggaagaatcggcggcatcttcgggcctttgctcgtcggaaccctggcagcccgtcatatttcgttttcggtcatcttttcaatcttttgcattgcaatcttactcgcggttgcttgtattttgattatggggaaagaaacgaaacaaactgagctagaataggaaaagcacctcttaaaagaggtgctttcagcgtgtcgacaaaccctcgcattcgttgtcaggactgcgcttcggtgctcaatgcgaagtggatcaacggctaaattctcaggcgtcctgcctaaacgccgtcgtcatcacatcctgtgaatgtccgctcctatgctcgtccttcctagacttcaagggttttcaatcacgctgaaaagattttgtcaacaatctgaggcacctcttgaatgaggtgcttttttttttttacatctgcgcccgggctgtggattggcgtttcccggttttactgattgtctggtagagcgtcatagaaagtatgaacagaatggcagtaaatcctgtgacagctccgaaatgctgtgtgctttgatataaaaaacctgcaatacttgtaccgacagtggttccggcatacatagcggcattggaaagggaagcgatggttcctcgcgcatttggtgcaatggattgaaagacacccatcattaacggaaagatgatgccagctgtaaagaacgtgagaaaaaagccggcttctactaaaaacaagtttggaaagaacggaagagcgaaatagagagcgcccattagcagcatcccgctgatcagtgttttaaacatgcccagcttttctgaaacccggctgccgataaggctcccgagcatatttcccagtccgagtacaagcatagctgcgccaatttgtgacacggttaaatgataatccgcggaaagccaagtacccagaaagctgaacgatgcgaagtttccggtttgaaacagaaaataggcaagcagaatgaccgatgttttcggcaatgaaaaaagctcccgataggggttgacaattgatgggcgcgccaatggttcagaaggccggatgccaggcatgaccgccgccaggatcaatagaagaataagcgagcacgctgacaaaacgaaaaatggcgtatgccatgtaaaggaagcgagaaaccctccaataggaagtccgagcatttgtgaagcggccaaacctgctgtcgcaatccccatgccttttatgatctgagaaggctggacaatgactgggatggacgcccaaatttgaggcgtcacaaacgcagcgctaacgcctgcggcaaaacggaacaggcacatggcggcaaaagagggagcgatgccgcataaaaatgtggatacgataaagcctgcaagtccccacagcatgactgttttcctgttcagccggtctgagattgggcctgcaatgaaagcgaagagcgcataaccgagtgcataagcactgaccatccagcctgacaaatcagtagagacatgaaactgatcctgtaaaagggggagaagcggcgaaagcaaaaaggtatccgtgccaatgacaaacatgacactgaagaaaagccaaatgcgattcaaattttatcactcctattgttttataactttgaaactatgaaacagatatgtatagagaaaaccctttgttagagggtttccaaaaagccaggcaggtatgtttgaaatgtgtcttcacgcagactgacgtattttgtacgcgaatctttccgggttgccgtcaatcccgcttcacgcagcgttttaaaatgataagatgccgtggttttgacaatattgcacttttcacctacttcaccgcagctgagttcttttccgctgacataaagcgtacgaataatggcaagccttgattcatcagacagtgctttaaaaatttgcgctctgatttgatcatctgattgtttcatagtcatgaaactataatacataattgatgttgaaaaagcaacttatttttccagtaaaggagagggaagtcataagaggaagaaggaattcaattccaataaaagcgttttcaactaaagataggcgaaaaatcacccgtaaaatacaatcatataggaggattacagagcatttagaagcataaataagatcatgtggtcacatggatgtttataaagaaatggtacagaataaaagagaatatgctgtttgtgtgggaagttacataaatgttacggtaataaagattgcttaatatggagggaaaatatgagtgtagatgagaaaccaattaagataaaagtcgagaaagtctctaagatttttgggaaacaaacaaagaaggcagttcaaatgcttgccaacggaaagacaaaaaaagagatcctgaaagcaaccggatcaaccgttggggttaatcaggcagattttgaagtatatgatggtgagatatttgtcatcatgggtctatcagggagcggtaaatcaactttagtacggatgttaaaccggcttattgaaccgactgccggaaatatttacattgatggtgacatgataacaaatatgtctaaagaccagctccgggaagtccgccggaagaaaatcagcatggtcttccaaaagttcgctctgttcccgcacagaacgatacttgaaaacacagaatatggactggagcttcaaggtgtagacaaacaagagcggcagcaaaaagcgcttgagtctcttaagctcgttggactggaaggatttgaacaccaatatcccgaccagctttccggcgggatgcagcagcgtgtcggccttgcccgcgcgttgacaaatgatccggacatccttctgatggacgaagcgttcagtgcgcttgatccattgattcgtaaagatatgcaggatgaacttcttgatcttcacgataatgtcggaaaaacgattatctttattacgcatgacttggacgaagcgttgcggatcggcgacagaattgtcctaatgaaggacggcaacatcgttcaaatcggcacgcctgaagaaatcctgatgaatccatctaacgaatatgttgagaaattcgtcgaagatgttgatttgtctaaagtcctcacagcaggccacattatgaaacgcgctgaaacagtgcggattgataaagggcctcgcgtagcattgacactgatgaaaaaccttggaatttcttcaatttatgcagtggataaacaaaagaaattattaggtgttatctatgcgtctgatgcgaaaaaagcggctgagtctgatttgtcacttcaagacatcttgaatacagaatttacgactgtaccagagaatacgtatctgactgagatttttgacgttgtgtccgatgcgaatattccaattgcggttgtggatgagaagcaaagaatgaaaggaattgttgtaagaggcgcgctgattggcgcacttgccggcaataacgagtatatcaatgctgaaggcactaacgaacaaacacaagatccttctgcacaggaggtgaaataagatggatagactgcctagaatacctttagcagatattattgaccgttttgttgactggattacgatgacgtttggcggattcttcgacggaatcgctaacggattggccgcttttgtaaatggaattgtcaccggtcttggatttattccatctattttgttaacgattattttcgccgcacttgcgtggtggatcagtacaaggggaattgcgttatttacgttgattggattcctcctgatcgattatttaggatattgggacccaatgctgcaaacattggcgcttgttttgacatctgtgattatttcgattgtggtcggggttccgatcggaatttgggcgtctcagaaagaaacggttcgccgtattgtaacgccaattcttgatttaatgcagacaatgcctgctttcgtatatctattgccggcgattttcttctttaacatcggtgttgtgccgggtgttgttgcatctgttatcttcgcgatgccgccgacaatccgcatgactgttctcggtattaaacaagtgccggcggatctgattgaagcgactgaggcattcggttctacaacagctcagcgtttatttaaagttcagcttccgcttgcgacaaaaacgattttggccggaattaaccagagcatcatgcttgcgttatcaatggttgttatcgccgcaatggtcggtgcaccgggacttggttctgaagtatacagtgccgttacacagctgaaaaccggggtcggagtagaggccggtatcgccatcgttatcgttgccattaccctggaccgtattactcaaaatattaaagtgaagaagaaaagcagggggaatgcctgatgcttaaaaaaatcatcggcatcggcgtttccgccatgctggcgctctcacttgcggcttgcggttcagaaaacgatgaaaatgcatccgcagcagaacaggtgaataagaccatcatcgggattgaccccggttcagggattatgtccctgactgacaaagcgatgaaggattatgacctgaatgactggacattgatttcagcgtcaagtgctgcgatgactgctacgcttaaaaagtcatacgaccgtaagaagccgattatcattacaggatggactccgcactggatgttctccagatataagctgaaatatctcgatgatccgaaacaatcttatggcagcgcagaggaaatccatacgatcacacgcaaaggcttcagcaaagagcagccgaatgccgcaaagcttctgagccagtttaaatggacgcaggacgaaatgggcgaaatcatgatcaaggtggaagaaggcgagaaacctgccaaagttgctgctgagtacgtcaataaacacaaggatcagattgccgaatggacaaaaggcgttcaaaaggtgaagggagacaaaatcaaccttgcctatgtggcgtgggacagtgagattgcaagtacaaacgtcataggcaaagtcttagaagacttgggctatgaggtaacacttactcaggtagaggctgggccgatgtggactgcaattgcgacgggaagtgcggatgcatccctttccgcatggctgccgaatacccataaagcatacgccgctaaatataaaggcaaatatgatgatattggcaccagtatgactggtgtgaagatggggcttgttgttcctcaatatatgaaaaatgtcaactcaattgaagatttgaataaataatggagaaagcagcctgtagccaggctgcttttttgcgttaagaagcgttagcggcagcaagtgattccgccttctgaaatgttttgagcacggcattcgctaaaatgtgaatgccgttgaacatcgcatttctgtcaaaggtcatgtgcggatgatggagccccggctggagcccgcagcctaggccaagcatcgttgttttcagattcggcaccttcacggcgtaaaaatggaaatcctctccgccggtagtgacaagcgggtcatcaagccgctcagccccgatgatatctgtaatggcttctgccatgatcgcttcagcttctttgttttgtgttgccgcaggaaggctgtgttctttttgcagctcgatttttgcgccgaatgcagcggcggccgcttcacaggctctttctgtttcggcgattaacgcctccatggcttcattggtctgtgcgcgcaaatcaaggctgaacgatgcttttcctggaatgatgttagagctttcaccgccggcttgaagttttgtcattttgacggtatgcgggatttgcgggtcaatatgaatgagtccgagcttatgtacaagaaatgccgcaatttcaatgctgtttttcccgaggtgcggacgggcgccgtgagcctcttccccgatgatcgttccctcaatgtgctggcttgatccgtgcagaatagacggagcgcagcggccgttctgtgtttcctggatcggacggacgtgaacgccatacaaatagtcgatatcatcaagcacgccttcttctatcattttcaaggcgccgccgcctttttcttctgccggctgaaagataaaacggattgtgcccttcggaagctcaggttgtttttttagcagcattaacgtgcccaatgccattgtcatatgtgaatcgtgtccgcaggaatggttggcgcgaaatgtgccgttaacctcctgccacagcgcgtcaatatcagcgcgtaccgctacaacaggtgagcctgagccgatttcgccgacaaccccggtgcagtctgaaaacgtgcgcgtccggcaccctaaatcctcaagcttttgtttcaaaaatgaagttgtctcatattccttccagctgacttcagggttcgcgtgcagatgctcgaagatgtccataatggtttgtttcatgtcttctgaaagcttttgcatggtaagaaatacctccttctatcagaatgaatttttaccttctttactttatttatattgaaacaggaagataggctgtatataatatagcacatattgctacttttcagaataattaatattttcaaacagaggggatggatcgaaatatgagtatgccagcagccgaaacacagcctaagaaaaaacgtatgacatttaaaatgcctgacgcctatgtcctcttatttatgattgctttcatttgcgcaatcgcttcatatattgtgccggcaggtgaatttgaccgcgtgacaaagggggatgtcacgaccgctgttccgggaagctatcattcaattgaacagtctccggtcagcttgatcagcttttttacttctctacaggatggaatggttggatcagcacccatcatctttctgattttattcacaggcggcaccattgctattctagaaaaaacgggtgccatcaatggcctgatttacaatgtcatcagcaaattccgcacaaagcaattattatttatttgtattgtcggcgcattgttctccattctcggaacaaccgggattgtcgtgaattcagttatcggttttatccccatcggcctcattgtggcacgatccttaaaatgggacgcagtcgcgggagccgctgttatatacatcggctgctacgctggatttaactccaccatattatcaccgtcaccgctcggtttatcacaatcaatcgcggagctccctcttttttctggaatcggcctgcgagttgtgatatacatatgctttttgctgtcttctattatttatatctatttgtatacgagaaaattaaaaaaatcaaaagatgccagtgtgttaggaacagattggttccctgcggcaggaatgggcgaagccggtaaagaagaagatcagtcagtgccgtttaccgttcgccataagctgattttggctgtggcgggactctcacttgtcggatttttatacggcgctttgaagcttggctggtcagattcccaaatggctgcgacatttatttttatttctgtccttgccggtttaataggcgggcttgcggcgaacgatattgccaaaaccttcattacgggctgccaaagtcttgtatacggggcgctgattgtcgggatggcacgaagcatttccgttatccttgaaaatggaaagcttctcgatactgtcgtcaatgctttggcttcacttttggatggattcagcccgattgccggggcaatcggcatgtatatcgccagtgcgctgcttcattttctcatctcttcagggtctggcgaagccgttgtatttattccaatcctggcgccgctcgctgatttgatgggaatcacgagacaggttgcggtggaggcagttatgcttggagaaggggtcgtcaactgtgtgaacccgacatccggcgttctcatggcggtgcttgccgccagcggtattccgtatgtcaagtggctgcggtttatggtgccgcttgctctgatttggttcttgatcgggcttgtctttatcgtgatcggcgtcatgatcaattgggggccgttttaacgattgctgcccgccggcttgtacggcgggcttttgagttattcattgcagaagcgcaggctgttattgtaacatgtaagccataagccattcgtaaaagtgcgggaggaaggtcatgaataatctgcgtaatagactttcaggcgtgaatgggaaaaataagagagtaaaagaaaaagaacaaaaaatctggtcggagattgggatgatagcgggagcatttgcgctgcttgatgtgatcatccgcggcattatgtttgaatttccgtttaaagaatgggctgcaagccttgtgtttttgttcatcattatcttatattactgcatcagggctgcggcatccggaatgctcatgccgagaatagacaccaaagaagaactgcaaaaacgggtgaagcagcagcgaatagaatcaattgcggtcgcctttgcggtagtggtgcttacgatgtacgacagggggattccccatacattcttcgcttggctgaaaatgattcttctttttatcgtctgcggcggcgttctgtttctgcttcggtatgtgattgtgaagctggcttacagaagagcggtaaaagaagaaataaaaaagaaatcatcttttttgtttggaaagcgagggaagcgttcacagtttcgggcagctttttttataggaacattgatttgtattcactctgccaagttgttttgatagagtgattgtgataatttaaaatgtaagcgttaacaaaattctccagtcttcacatcagtttgaaaggaggaagcggaagaatgaagtaagagggatttttgactccgaagtaagtcttcaaaaaatcaaataaggagtgtcaagaatgtttgcaaaacgattcaaaacctctttactgccgttattcgctggatttttattgctgtttcatttggttctggcaggaccggcggctgcgagtgctgaaacggcgaacaaatcgaatgagcttacagcaccgtcgatcaaaagcggaaccattcttcatgcatggaattggtcgttcaatacgttaaaacataatatgaaggatattcatgatgcaggatatacagccattcagacatctccgattaaccaagtaaaggaagggaaccaaggaaataaaagcatgtcgaactggtactggctctatcagccgacatcgtaccaaattggcaaccgttacttaggaactgaacaagaatttaaagaaatgtgtgcagccgctgaagaatatggcataaaggtcattgttgacgcggtcatcaatcataccaccagtgattatgccgcgatttccaatgagattaagagtattccaaactggacacatggaaacacgcaaattaaaaactggtctgatcgatgggatgtcacgcagaattcattgctcgggctgtatgactggaatacacaaaatacacaagtacagtcctatttgaaacggttcttagaaagagcattgaatgacggggcagatggatttcgctttgatgccgctaaacatatagagcttccggatgatgggagttacggcagtcaattttggccgaatatcacaaatacatctgcagagttccaatacggagaaatcctgcaggatagtgcctccagagatgctgcatatgcgaattatatgaatgtgacagcgtctaactatggacattccataaggtccgctttaaagaatcgcaatctgggcgtgtcgaatctctcccactatgcatctgatgtgtctgcggacaagctggtgacatgggtggagtcgcatgatacgtacgccaatgatgaagaagagtcgacatggatgagcgatgatgatatccgtttaggctgggcggtgatagcttctcgttcaggcagtacgcctcttttcttttccagacctgagggaggcggaaatggtgtgagattcccggggaaaagccaaataggcgatcgcgggagtgctttatttgaagatcaggctatcactgcggtcaatagatttcacaatgtgatggctggacagcctgaggaactctcgaacccaaatggaaacaaccagatatttatgaatcagcgcggctcacatggcgttgtgctggcaaatgcaggttcatcctctgtttctatcaatacgccaacaaaattgcctgatggcaggtatgacaataaagctggggcaggttcatttcaagtgaatgatggtaaactgacaggcacgatcaatgccagatctgtagctgtgctttatcctgatgatattgcaaaagcgcctcatgttttccttgagaattacaaaacaggtgtaacacattctttcaatgatcaactgacgattaccttgcgtgcagatgcgaatacaacaaaagccgtttatcaaatcaataatggaccagagacagcgtttaaggatggagatcaattcacaatcggaaaaggagatccatttggcaaaacatacaccatcatgttaaaaggaacgaacagtgatggtgtaacgaggaccgaggaatacagttttgttaaaagagatccagcttcggccaaaaccatcggctatcaaaatccgaatcattggagccaggtaaatgcttatatctataaacatgatgggagccgggcaattgaattgaccggatcttggcctggaaaaccaatgactaaaaatgcagacggaatttacacgctgactctgcctgcggacacggatacaaccaacgcaaaagtgatttttaataatggcagcgcccaagtgcccggccagaatcagcctggctttgattacgtgcaaaatggtttatataatgactcgggcttaagcggttctcttccccattgaggacaatgctagacgggacttaccgaaagaaaccatcatagatggtttcttttttgttcataaatcagacaaaacttttcccttgcaaaagtttgtgaagtgttgcacaatataaatgtgaaatacttcacaaacaaaaagacatcaaagagaaacataccctggaaggatgattaatgatgaacaaacatgtaaataaagtagctttaatcggagcgggttttgttggaagcagttatgcatttgcgttaattaaccaagggatcacagatgagcttgtggtcattgatgtaaataaagaaaaagcaatgggcgatgtgatggatttaaaccacggaaaggcgtttgcgccacaaccggtcaaaacatcttacggaacatatgaagactgcaaggatgctgatattgtctgcatttgcgccggagcaaaccaaaaacctggtgagacacgccttgaattagtagaaaagaacttgaagattttcaaaggcatcgttaatgaagtcatggcgagcggatttgacggtattttcttaatcgcgacaaatccggttgatatcctgacttacgcaacatggaaattcagcggcctgccaaaagagcgggtgatcggaagcggcacaacacttgattctgcgagattccgtttcatgctgagcgaatactttggcgcagcgcctcaaaacgtgcacgcgcatattatcggagagcacggcgacacagagcttcctgtttggagccacgcgaatgtcggcggtgtgccggtcagtgaactcgttgagaaaaacgatgcgtacaaacaagaggagctggaccaaattgtagatgatgtgaaaaacgcagcttaccatatcattgagaaaaaaggcgcgacttattatggagttgcgatgagtcttgctcgcattacaaaagccattcttcataatgaaaacagcatattaactgtcagcacatatttggacgggcaatacggtgcagatgacgtgtacatcggtgtgccggctgtcgtgaatcgcggagggatcgcaggtatcactgagctgaacttaaatgagaaagaaaaagaacagttccttcacagcgccggcgtccttaaaaacattttaaaacctcattttgcagaacaaaaagtcaactaaccgcaactttagagtaaagggctgattgtcaatgtgggagcagttgtatgatccgtttggaaacgagtatgtgagcgcacttgtggcgctcactccgattctcttttttcttttggctttaactgttttgaaaatgaaaggcattcttgcggcatttcttaccctagccgtcagtttcttcgtctccgttttggcatttcatatgccggttgaaaaagcgatttcttctgttttgttaggaatcgggagcgggctgtggcccattggctacatcgtcctgatggcggtgtggctgtataaaatcgccgtgaaaaccgggaaatttaccattattcggtccagcattgccggcatttcgcctgaccaacgattacagctattattaattggtttttgttttaacgcgtttttagaaggcgcggccggttttggtgttccgattgcgattagtgcggcgctgctcgtcgaacttggttttaaaccgttaaaagcggcggcgctctgcttgattgcaaacgccgcctccggagcctttggggcgatcgggattcctgtcatcacaggggcgcagattggtgacttgtctgctcttgagctgtcacggacattaatgtggacactgccgatgatctcatttttaataccattcctgcttgtattcttattagaccgaatgaaaggaatcaaacagacatggcccgctcttctggttgtgagcggtgggtatacagcggttcagacactgacaatggcggtgctcgggccggaattagcaaacattttggcggccttattcagcatgggcgggcttgccctcttcctccgcaaatggcagccgaaagagatttaccgcgaggaaggggccggcgatgctggtgagaaaaaggcataccgtgctgctgatattgcgaaagcgtggtctcctttctacattttaactgcggcgatcaccatctggagccttcctgccttcaaagcgcttttccaagaaggcgggctgttatatcaatcaacgctcctgttcaaaatgccttttctgcatcagcaaattatgaaaatgccgccgattgcgccatctgccatgccgttagatgcagtctttaaagttgatctgctgtcagcgactggtacagcgattttagcggcggtcatcgtgacagggctgttcagcaaaaagttctcctctcgggatgcctttgcttccctgaaggagacaggaaaagagctgtgggtgccgattatgacgatctgcttcgtgatggggtttgccaatctggccaacttcgcagggctcagctcttcaattggattagcattggcgaaaacaggagacctgttcccgtttgtcagtcctgttcttggctggattggcgtgttcattactggttctgttgtcagcaataatgctttgttcggtcatttgcaggttgtcaccggagcgcagatcggtgcgggttcagacttgctgttagccgcaaatacggcgggcggtgtcatggcgaaacttgtttctcctcaatctatcgccatcgctgccgcagcggtcggccaaacaggcaaggaatctaaactgtttaaaaagacagtggcgtacagcctgattctgttagtgattatttgtatatggacgtttattcttgcaagatttggagtgtaatagaaaaaagcagtacatgcccagcatgtactgcttttttatgttaatttgctttctttgtcatttcggctgttgttttcactctggctttccccataaataaaatggtaaccgccgcgaggacaattggaatcaaagcgagcaaaaacacatacgtaatacttgatgacatcgcgtcaataatgcgattcaggatcgcatcaggaatctgggaacgtgttcccgcttggaatatctcctgcgggtcgccaatattttgcgcagcacctgatcccgctgagcctttcatcccgctgaaggcgtcggtcagcttgttcgtgaatacgtttgtttgcaccgttccgaaaatggtgacgcctaaggtcatgccaaatgatcgcaaaaatgaatttgtagagtttgccgttccccgaaagcgaggttcaagatcattcatcgatgccgccggcagcagggagaagttaaagcctacaccaaagcctgaaatcatcataaagactgtcagccatacccgtgctgtgtcaggcgtcatattggaaagaagcagcatgccgataaagaaagctataacagatatcagcatcaaattgcggaagcttgccttcgtttggaagatcccgccgatcatgcttccgatgactgatccaatcatcatcggcgtcagaatgaagcccgcgcttgtcgccgagctgccgtagaccgcctgaacgaaaatcggaataaataccgctaaaataataaatgttccgccatacaggaaagcgagaatctgtgctgtggcaaacaagcggttcttaaacatccagaaagaaataatcggctcttctgcttttctctccacaataaaaaaggcaatgaagaaaacggcgaatacaataaacagcccgatgatctgaatggaattccaatcgtatgttttgccgccaagctcaagggcgaacatcaggcatacaatggatacgactaaggtaatcgcgccgccccagtctattttctgctttctgtgctccagagattctttgtagtagcgaataatgaaaaacaatgacaatgcgccgatcggcacattgatgtaaaacacccagtgccagctgatcgaatctgtaatgatcgcgcctaagagcggaccaagaacactggataatccaaatacagcaccgaacatgccggacatttttccgcgtttttccggcggaaacaaatcaaagataatggtaaaggcaatcggtaggagcgcgccgcctccgatcccttgaatggcccggaagatgatcagctgattcatcgtctgggcaatcccgcataaagcagaaccgattaagaaaaaaataagtccaaacaggaaaaaacgttttcggccgtacatatcggaaagcttgccgtaaatcggcatgccagccataaccgccaccatataggatgccgtcacccatgcaaatttatcgaagcttccaagatcggctacgatattgcccatcgcggtggcaacaatcgtattgtccattgcagacatcaagatgcccagcaggagaccgaggaccacaaatttggtggaagcctgttttgctgttgttgtgtccatttgttctacctcctcttacttttctatgtaagttctgatatcatgataatagtttgattgttgaatatctcgattatcaagataaactcgattttatagggaggactgtcagttgtcaacaagaaattccagaagtgagttggaaaagactgctgttcagctttttcgaaaactgggcacaagaacggttctgtttcatcaggcagccgctcaagctctcggtctgtttcccaccgatttgaaatcagctgacattttaaatgaagcagggccgatgacggccggagaactgggaaaaaaaaccggcctcagcacggggtcagtcacggcgcttgttgaccggctggaaaaagcggggtatgtggctcgtgaaaaggacccgaatgatcgcaggagagtcgtaatcgtccctttgactgcttcgaaaaaacatataaaggatttgttccgtcctctgtctgagtcaacgatggatttgtgccgcgaatatacggaagaggagctggaactcattttcagttttgtaggcaaagccgccgatattatggaggaagagcttgaacgtctgaaacagtaagtgaatttgtgcatagcttggcccgttcccgaataaattgtacaagttacataagagaagggagtacgggccggtgaacatttttttgagctatattgtgctgggactgtccttgtctgcgcctgtggggccagtgaatgcggcgcaaatagacaaaggaattaaaaacggtttttggcatgcatggattttcggtttaggcgccatgacagcggatgggctgtacatgctttttatctatttcgggctgtcgcagttcttgaccgctccatttgtgaaaacgtttttgtggctcttcggcttttttgtcctgacctataccggaattgaaacgctgaaaaacgtcagagaaccgatggatgtgcgaagctcacgggggaaaccgtcatacaggaaaacattcgcatcgggttttctcatttcattgtcaaacccattgagcatccttttttggcttggaatttacggaagcattcttgcgaaaacagcagaggcctacaatatgaatcagcttctaatctatagctccggcatcatgatcggcattttaatctgggatttctgcatggctatcacagccagtacgttcagaaacctgcttcatgaaaagctattgagaggattgaccggaatcgccggtgtatccctccttgtgtttggcttttactttggttatcagggcatcaaacagttattgggctgattcatgaaggacagtcacctgccgcttccagttttaatatagtatccagatgatactggaggtggatcaatggtgaatgggatttacaccaaaagttttctggaacgtattcaggaagagcttcctgaatggcaaagaatcgcttttgagctgctggcagaaactctgggggacgacgcggatacgtttccgtgcattcccggacgccaggcgtttctgactgatcagcttcggattgcttttgccggagatccgcgggaaaaccgcacagcggaggaactggctccgttgcttgcggagtacggcaagatatcgcgggacacgggaaaatacgcatccctcgttgtgttgtttgatacaccggaagatttggcggagcattattcgattgaagcgtatgaagagctgttttggcgctttttaaatagactgagtcatcaagacgaaaaagaatggccggaagacatttcggccgatcccgagcattataaatgggagttttgttttgacggcgagccgtactttcttctctgcgctacaccggcgcacgaggcgagaaaaagccgaagctttcctttttttatgatcacgtttcagccaaggtgggtgtttgaggacctaaatggatcaactgcatttggccgtaacatgagcaggctgatccgatctcgtttagaggcctatgatcaggctccaattcacccgcaattaggctggtacggaggaaagaataatcgtgaatggaagcagtatttcctccgtgatgacgaaaaacaggtatcgaagtgcccgttttcttatttaaagaacatgttcaacagaatgaaataaatcaaggactggcagggcgatctttatgaccctgctttttttgatagatcatggtcacgatggcgatgatcacgagaaaacctatgctgacgaaaaaaccgggccggcttgatttttcaaacaatgtaccggacacagccgcagcaatcagaaccatcgctaaataaatttgcgtttttcccatgccctcgggatcagtcagctttttgctggagaacaggataaacagccaagtgtataaaagcataagccccgcagctgttgtcatatgctcataaatgtttttaggcagcactaacgacagaataatggagaggacaagccccgcaaacgtcagcccaagtgccggccagcatatttttttgccttcctttagagtaaagcatttcggcgcgtcgccgtcatcagccattgtacaaagcaatgtcgtaaccgcaaatagcgaagcgacaagggtcgagaaccctgcgatgatgaaaatcccgttaaatatatcaaggatgatctcaaggttatatccttttaatgacgtaatgaacggactgtcctgttcagtaaacgtgtgtaacggaaccaaaagcagagcaagcccgattgaaatgatataaataatcgccagcgtcgccagcatcagtttccctgatttagacgcttcctcaggtttttttaagtgaaccgccatcagccccatgacctcaattccgccaaaagcgtaaaacgcgtagattaaacctgtccacagccccatggcgccgtatgggaaaaactcactcgtcttatttggaacatgtatgccatgatttccgccggacaggatcccgcataaagccaggatggcaatgacaataaacataaaaatagcagctgttttaatcactgccagcacgttttctgttttttcaaagacggacaggccggtgaaaataataaggagccccagtactgcgtagattgaggcaaacacccatagcggcacttgaggaaaccaatgcttcgtaaagagcgaaatggctgtcagctggcttccggtaatcagcatttctgatgaccagtacacccagccgttgctgaagcctgcccatttgccgaatgcttttcgggcatacgcacaaaacgaacctttttccggctgcttcgccgatagcttggcgagctgttcaaagacaaaatacgtaccgatccctgcgatcagaaatgaaaggagaacggaaaaaccgctttttacaattgcgatgctggaaccgagaaagaagcctgttccaatcgtgcagccgactccgatcagtgacagctgccaccaagccagattcccttttggctggtctttttttgtttggctcattatttattcaaccccttttatctaaggttagattgtgatctgtccgaagcttatatacatcggatttttgcctctttttacatggagaaggaagcggacgctcatactaatgaaaaaaggagcaaaccaatgacacagcaatatattgtggagccgaaaaaagggctggggctgaagctgaaaaaggggcagattttaaaggtggttgatgtagaagggcagcaggtggctgattttgtcgcataccatgccaaggatttttatgaacaccttgatcagggagcgacgatagacgccaatcactccattcatgtgaaggtcaacgaccatctctactccaacctgtataagccgatgttaaccctgattgaagatacggtcggcaagcatgatctgctgctgcccgcctgccgtcctgatatgaacaggctcttatatgggaagcaaaaggatgagtttcaggatacgtgctatgacaatatgaaccgtgcgcttgagcagtttggcgtaccgaagcctcacatgcattacccatttgcgatttttatgaatactgtccttgatgagaaagggaatctgtctgtggaaacgccgctttcgaatgccggagattatgtaaggctcagggcggagatggatttaattgtcgcgttttcttcctgcccgattgaaaaagggaaatgcaatggcgacagtgtgacatccatacgggttgaagtcagctgatctctcttgttcactgtgaatgaagacctgtgctatatttaatagggatacataacagtcatgattcattttcattgatttggggaaatgatcagtaacaagggaaaatgtacaggaggaatgattgggatgagcatgcaggaaaagattatgcgtgagttacatgtgaagccctcaattgatccaaagcaagaaattgaggaccgagtcaattttttaaaacaatatgtaaagaaaactggtgctaaaggctttgtattgggaatcagcggcggccaggattcaacacttgcgggaagactcgctcagcttgcggtggagagcattcgcgaggagggcggagacgctcaatttatcgctgtccgtcttccgcatggcacacagcaggatgaagacgatgcccagcttgctttgaagtttattaagccggataaatcatggaagtttgatattaaatcaacagtcagcgctttttctgatcagtatcagcaggaaacaggcgatcagctgactgactttaataaaggaaacgtaaaagcaagaacaagaatgatcgcgcaatacgcgatcggcggccaggaaggccttcttgtgttaggaacagaccatgctgctgaagcagtgactggtttctttacgaagtacggtgacggcggagcagacctcctgccgctgacaggcttgacgaagcgccagggaagaaccctgctgaaagagctgggtgcaccggaacgcttatacttaaaagagccgactgccgatctgctcaacgaaaaaccgcagcagtcggatgaaacagagcttggcatttcctacgacgagattgacgattatctcgaaggaaaagaagtatcagcgaaagtatcagaagcgctggaaaaacgctacagcatgactgaacataaacgccaggttccggcgtctatgtttgatgactggtggaaataagttgaagaaagcccgctctcggagcgggcttttgtcgtgtacagaagctttatttgatgcggatatgattcagctttaccattaatctgtcggcgaaccttcggaggctgcctcttgtatcaggatctaatgggagttcggctctcgcggcaatgttctctgccacatcctgaatcgacaggttgtctgtttgaatgtggtcctcaaaaatgggtgatgataatccttcaacacagcggtcaatttgtttggcggcccatgagttttttccttctgctctggtgcgcagcctttttaacaaggtttcctttgaagccattagtgtaaagtggtgaacgatcctgccttcctgtctgagcctgccgatgatctcattgaagtattcagggtgtacaatcgtcataggcacaataaggatgccgcggtatgtatctgtcagagaagctagcaaactgtaattgaacgcccgccataaaggatagctttgaaaatcgtcctttgcgatctcctgcggcaccatggagcgcagcgcaaaacccattttctcgggatcatacacgtaagatgggctcagccttctgtgcagttcgaaggctgtttgtgtttttcccgaaccgaatgccccgtttatccaaatgatcatcgccatttctcccttcctatttatcatacagaaaaagacccttccatcgaagagtcagctggaaaaacaataaaggcggaaggttttaacgcttttttgcgtcgaagtattaaaatacctgcagaaatgttgtacaatgaatgtcattcaggcaaaaatggctacaacaaagcgcactataagcttgaccggtaaagccggtatctatataaatattcgctaaataagcatataatgaatatataatttcattccttaggaggatttcgccgaagatgaacgctaaacgagccatcccagtaagagaaagaaatatcgtcctgatcggattcatgggtgtaggaaaaacaacaatcggccaattggtcgctaaaaaattatatagagattttattgatattgaccagcagatcgaaaaggatttcaatatgtcaattcctgagatatttgagaaaaagggagaagactttttccggaaaacggagaaggaatatattttagacatctgccatcataaacgattcaaaatcgtatctctgggcgggggatcttttaaacaagaagaaatcagaaattgctgtctggaaaactgtctcgtgcttcatctggacctgtcatgggagaactggaagcagcgcgcggatttattgatcgaaagccgccctgtactgcataaccgttcaatggatgaaatggaacagctgtttaacgaaagaaaagtcatttatgacaagcacaattcaaaagtggcaacagacaacctttccccggaagaggttgccgattacattgttgagacattaaaaattggctgggatctttatcagccgatgtaaaaagccgtgcgcagcgcacggctttttttatcgttttatcccttgtatcaaaatcgcttttaaacaaaaggagatgggctgtccgttttggttcaatgtaatacagaacgtgtcgcgtgcttcgtctgatgcgtgattcaagtgggtaatgatttgtttttctcggtcagcgggggttccgcctcgtttgatccagctatcgtattgaatcggcaagttccacttttggatgtcttgataggccagttgattggcgctgaacatcgcctgccattctgataatgagctttcacgaacatgggaagggtctcgaagccggttcaaatgattgacaaactcatcaagaacgggatcttcaggcgcgtaatgatcaactaagagaaaacgtccgtcctgttttagtacgcgtgcaacctctctgacagctttgcggacatctgaaaaatggtgggctgcgtatcggcaggtgatgatgtcaaatgaatcgtcggggaaggggagtgactctgccgttccttgctgaaagcgtacgttttcaactcctttttcttgcgcgaaggaggacgcaacctcaaccatctctttcgttgcatcaacaccgatgcactcctgtacataaggagaaaatgccagcgccgtatggccggcgcccgctcctatatccagcactcgatgctctgcccggcattccgctgttttgatcatcaaccccaaatcttccccctcggcaaataccttttcatcccgatacatctcggcgtttttagaaaacggtgtttcatttgtcatttgaaccagctccttcttttcgtaaatgatgatatggattatgttagcaatttctgttatgattcgtccaagatataaaaatgatgaaaatgataggttcaacctatggaggctgaaatggatattaaagtgatggaatatgcagcggaaattgcccggcgccaaagctttacaaaggcggcggaacatcttcatatcgcacagccgtctctcagccagcaaatcaaaaagcttgaggctgagctggggcttaccctttttcacagatcccatggctctgttacactgacacctcacggcaggcgtttcattgaaaaagccgaggacatcattcgttccagagatgatttgcttcgggaaatgcaggagcgatcacagggaatcggtcataaattatccatcgggattcctgctgtaacagggagatatctctttcctccgctgctgaagcagtttttggcgcgctatcctcatgtggaggttcagcttgttgaaaaagatccggtttcattagagaagatgacggcaaagggagaagttgacctttctgttttatccttgcccatcgaggatgaacggctctccattacacccttgctcacggaaccggttgttctcgcggtgccgaaggaaaaacaaaggtggatgccgccggaattggtcgcgctgattgagaaagcgctggaagaagatgagggacgccagccgtgtgtgccgattgacatggtaaggaacgtgccctttattctgttaaaagaaggcttcggctttcgcaggacagttctcgatctctgtgcggaaagcggctttaagccgaatgctgcctttaagacgagccatattgaaaccgcccaatctcttgtggctaacggattaggtgtgacaatggcaccgaatatggtcagaagggataaagatccgggtgtgatctatttatcgattcaatccgcgccatcacgaaccctcgtctttgtctttttaaagaaccgctatgtcagtctgacggcccaggcctttatggaactaagccgggaaagtcttaaacaaacgtttgatgaaggctgtctgggaaacaaagatgaaaatatttagaaaacaaagacgaaacgtggtagtataggaatacaaactaaatcttataaaacaaaggggaataatcggaaatgcaactattcgatctgccgctcgaccaattgcaaacatataagcctgaaaaaacagcaccgaaagatttttctgagttttggaaattgtctttggaggaacttgcaaaagtccaagcagaacctgatttacagccggttgactatcctgctgacggagtaaaagtgtaccgtctcacatataaaagcttcggaaacgcccgcattaccggatggtacgcggtgcctgacaaggaaggcccgcatccggcgatcgtgaaatatcatggctacaatgcaagctatgatggtgagattcatgaaatggtaaactgggcactccatggctacgccacattcggcatgcttgtccgcggccagcagagcagcgaggatacgagtatttcaccgcacggtcacgctttgggctggatgacgaaaggaattcttgataaagatacatactattaccgcggtgtttatttggacgccgtccgcgcgcttgaggtcatcagcagcttcgacgaggttgacgaaacaaggatcggtgtgacaggaggaagccaaggcggaggtttaaccattgccgcagcagcgctgtcagacattccaaaagccgcggttgccgattatccttatttaagcaacttcgaacgggccattgatgtggcgcttgaacagccgtaccttgaaatcaattccttcttcagaagaaatggcagcccggaaacagaagtgcaggcgatgaagacactttcatatttcgatattatgaatctcgctgaccgagtgaaggtgcctgtcctgatgtcaatcggcctgattgacaaggtcacgccgccgtccaccgtgtttgccgcctacaatcatttggaaacaaagaaagagctgaaggtgtaccgctacttcggacatgagtatatccctgcttttcaaactgaaaaacttgctttctttaagcagcatcttaaaggctgataaatgtgaaaagccgccgcatatcatcaggcggtttttttctgcaaactgccggaatgagaacagactggagacgaatagatatgaaacaaagaatcattgatgaattaaaacggatcgagcagtcatacggagtcaaaatcgtgtatgccgtcgagtcaggaagccgcgcatggggatttccctcgcaggatagtgattacgacgtccgctttatttatgttccgaaaaaggagtggtacttttcaattgagcaggagcgtgatgtcattgaggaaccgattcacgatttgctggatatcagcggctgggagctgagaaaaacgcttcggcttttcaaaaagtcaaaccctccgctactcgaatggctgtcctcagacattgtgtattatgaagcatttacgaccgcagagcagttaagaaaactccgcacggaggcatttaagcctgaagcaagcgtgtatcactatatcaatatggcgagaaggaacgtcaaggattatctacaaggacaagaggtcaaaattaaaaagtacttctacgttcttcggcctattttggcctgccaatggattgaaaagcacggaaccataccgccaatggactttactgttttgatgaatgaacttgttgctgaacccgagctgaaggctgaaatggaaaccttgcttgaacggaaaagaagaggggaagagcttgacctcgaagcaagaatcgatgttattcaccaattcattgaaacggaaatcgaaagaatcatggaagcggcaaaagaactgaaggcagagaaaaaagatatgacatctgaattgaaccgtttgcttttgaatacggttgaagaagtgtggaaggatggaggaagctgatgttttttgtcgcttccttttctcctttattcgacagaatccccccccgactttctaactatctgattgtggcaaacccacaaaaataatcagaatatttgtattttgagaatattgtgaacgctggttttgtccatttacaataaactcatacaaatacttcttagattgcggggtgttgaggttggaagtgatcacaagagattttttcttatttttatccaaaagcggctttctcaataaaatggcgaggaactggggaagtcgggtagcagcgggtaaaattatcggcgggaatgactttaacagttcaatcccgaccattcgacagcttaacagccaaggcttgtcagttactgtcgatcatttaggcgagtttgtgaacagcgccgaggtcgcacgggagcgtacggaagagtgcattcaaaccattgcgaccatcgcggatcaggagctgaactcacacgtttctttaaaaatgacgtctttaggtttggatatagatatggatttggtgtatgaaaatatgacaaaaatccttcagacggccgagaaacataaaatcatggtcaccattgacatggaggacgaagtcagatgccagaaaacgcttgatattttcaaagatttcagaaagaaatacgagcatgtgagcacagtgctgcaagcctatctgtaccggacggaaaaagacattgacgatttgaattctttaaacccgttccttcgccttgtaaaaggagcttataaagaatcagaaaaagtagctttcccggagaaaagcgatgtcgatgaaaattacaaaaaaatcatccgaaagcagctcttaaacggtcactatacagcgattgccacacatgacgacaaaatgatcgactttacaaagcagcttgccaaggaacatggcattgccaatgacaagtttgaatttcagatgctgtacggcatgcggtcgcaaacccagctcagcctcgtaaaagaaggttataacatgagagtctacctgccatacggcgaggattggtacggctactttatgagacgccttgcagaacgtccgtcaaacattgcatttgctttcaaaggaatgacaaagaagtaaaaaaggagagattatcatgacaacaccttacaaacacgagccattcacaaatttccaagatcaaaacaacgtggaagcgtttaaaaaagcgcttgcgacagtaagcgaatatttaggaaaagactatccgcttgtcattaacggcgagagagtggaaacggaagcgaaaatcgtttcaatcaacccagctgataaagaagaagtcgtcggccgagtgtcaaaagcgtctcaagagcacgctgagcaagcgattcaagcggctgcaaaagcatttgaagagtggagatacacgtctcctgaagagagagcggctgtcctgttccgcgctgctgccaaagtccgcagaagaaaacatgaattctcagctttgcttgtgaaagaagcaggaaagccttggaacgaggcggatgccgatacggctgaagcgattgacttcatggagtattatgcacgccaaatgatcgaactggcaaaaggcaaaccggtcaacagccgtgaaggcgagaaaaaccaatatgtatacacgccgactggagtgacagtcgttatcccgccttggaacttcttgtttgcgatcatggcaggcacaacagtggcgccgatcgttactggaaacacagtggttctgaaacctgcgagtgctacacctgttattgcagcaaaatttgttgaggtgcttgaagagtccggattgccaaaaggcgtagtcaactttgttccgggaagcggagcggaagtaggcgactatcttgttgaccatccgaaaacaagccttatcacatttacgggatcaagagaagttggtacgagaattttcgaacgcgcggcgaaggttcagccgggccagcagcatttaaagcgtgtcatcgctgaaatgggcggtaaagatacggttgttgttgatgaggatgcggacattgaattagcggctcaatcgatctttacttcagcattcggctttgcgggacaaaaatgctctgcaggttcacgtgcagtagttcatgaaaaagtgtatgatcaagtattagagcgtgtcattgaaattacggaatcaaaagtaacagctaaacctgacagtgcagatgtttatatgggacctgtcattgaccaaggttcttatgataaaattatgagctatattgagatcggaaaacaggaagggcgtttagtaagcggcggtactggtgatgattcgaaaggatacttcatcaaaccgacgatcttcgctgaccttgatccgaaagcaagactcatgcaggaagaaattttcggacctgtcgttgcattttgtaaagtgtcagactttgatgaagctttagaagtggcaaacaatactgaatatggtttgacaggcgcggttatcacaaacaaccgcaagcacatcgagcgtgcgaaacaggaattccatgtcggaaacctatacttcaaccgcaactgtacaggtgctatcgtcggctaccatccgtttggcggcttcaaaatgtcgggaacggattcaaaagcaggcgggccggattacttggctctgcatatgcaagcaaaaacaatcagtgaaatgttctaagcgggactaaatgggcatcctccctgcgggggtgtccatttcatccatatactataaaaaagaggaggaagtgccatagaaaacacacagctgattatttcgatttgtatttatatggcgggaatgctgctaatcggctactttgcttacaagcgtacgtcgaatctgacggattatatgctgggaggacgctctttgggtccggcagtaaccgctctcagtgccggcgctgccgatatgagcggctggctgctaatggggcttccgggcgccatgttttctactggtctgagcggcgcttggatcgtcatcggactttgccttggagcgtgggcgaactggctttacgtcgcaccacggctgagaacctatactgaaaaagcggggaattctattacaattcccggattcctggaaaatcgcttcggagatcaaacaaagcttctcagactgttttcgggaattgtcattttagtctttttcacgttttatgtatcgtccggaatggtgtccggcggcgtcttattcaacagcatcttggggatggattatcacaccggcctgtggattgtgacgggtgttgttgtggcatataccctgtttggcggctttttggcagtcagctggacagattttgttcaggggattattatgtttgccgcactcattcttgtgccgatcgttacgtttttccacacgggaggagcaggtgatacagttgctgaaatccgctctgtagatcctgatatgtttaatattttcaaaggaacgagcgtccttggcattatttctttgtttgcctgggggctgggatactttggccagccgcatattattgtgcgttttatggcgataacgtctgtcaaagagatcaaaagagcgcgcagaattgggatgggctggatgattttgtctgcagtaggcgcagtgctgaccggtttgggcggaatcgcttattaccatcagcgcggcatgacactgaaggacccagagacgatttttattcaattagggaatatcttgttccatccgattatcacgggttttctgatttcagcgattttggccgcgattatgagtacaatttcttcccagctgcttgtgacatcaagctctctggtagaagatttgtataagtcgatgttcagacgctcagcttcagataaagaactggtgtttttaggccgactggctgttctggctgtttcaattgtcgcgttggttctggcttgggagaaaaataacaccatccttggattggtcagctacgcgtgggcgggcttcggtgcatcattcgggccagttgtactgctcagtctgttttggaaacgaatgaccaaatggggggcactcgccggcatgattgtgggagcagcgactgtaatcatttgggcgaatgccggtctttcggactttctgtatgaaatgatacctggttttgctgcgagtctattatctgtcttttttgtcagcatattgacgcaggctccgtcacaagctgtcacagaccagttcaacgactaccaagatacaatgtcgcaataaagatcgaaaggaggaggaaggggctgtccctttttcctcttttctccttttaagcggccatttttttcttttggaaacaaacgtatttttttctatacaaaaagaccccgtatggatatgattaaagtaaaaaaagtataggagaaaaaggtatggaagagcttttagagagagttttttcattttcagatgttgataagctaattgattttattagctatgaactgcaaaagccagtgatactggaaagcgcggatttctttttgttagcctataattcttactatattaaccattttgattctgccaaccagcagactattttttcgaaaaagtgtccggtccagatttttgagaggtttctgaaggacggaattattgaaaaattgaaaacagagcctgagccttttcgcgtcaataaaattgaaagcattgggttaaaccagagggtggtcgtgagtgcaaagcacaaaggggaagtcatgggctacatctggattcaggagctggaccaaaatctgacggatgaagagctcgactttttgtacgagacctccttccatgtcgggaaaatcatttataaaacgaataaattgaaacaggaaaaggaagaaaaagcagaggatctcatcaaacgggcgatctatcagcaatttacctctgagaaggaactcagacgggaagctgaaaggatcaacaccgtgctgccttccatgttttcagttgttatcctgcacgccgcaaatggggatggggaagcggttgaggatttaaaggaaaatatcaggtcgtacctgaatttacgggataaggtcagtcatgtcttaacgatcgaatcaaacattgtcatcgtcgtagcgagtttttcccaaaaaagctccgtctcctcagcagcttctgagtttattaacaagctgttaacacattttcactttcaaaaaatacctacccctatttatatcggtatcggaaacgaatataatcacctattaaaacttggcaagagctacacagaagcacttgaagtcatcaaagccgcagaaatcaccggcaatcaggaaaacattccatatgaatatgccaaactcggcatttaccgctatttagaaagcatcgaacagaaaaatgaatttttagaatacgagaataaagatttagctttattaaaagcaaaagacgaagaaagcagcactgagctgctcaaaaccttggaaatctatctcctcaacaactgcaaaacaaaaccagcggcagaacagctgtttattcaccaaaatacattgaattaccgcatcaaacagattactgagatgacgtcgatcgatttaagcgatttcagaacgcggtgccagctctatctcgatttgatgctgatgaaaaagaaataaaaaagaaaccagtacttgtactggtttcgtcttcacttaaaatcctctgtaaacatacggatcatcaggttttttaatggtattccagtcagttactttgacgacagggagagttgacttgaatggctggtaatattctgaggccagagtgcccttaatgtgaatccattcatcatccttgatgtccatgtccttcggaaattccacaagcatcccgtacacgccggaatcagcgatacagtgaatgatgccaaaccttaatacgaacagctgatttttgttaattgcgtttcctttgtaagcaaatccatgaaattctatcgtccgtccgagaaattcacccggatagttatagatggtttccattccttttaggaaatcgtcatcggtcagagaaatctcttttttgctggaatacttattaaacagctgtttcatttgtttgtcatagctgtcttgcgcgtaataaaggctggcatcaggccgcaaatactgtgtttgggagtagtgatctccgctctccatcgccttaaacgagaacccttttgttttgactatggatgagtcaagcgttgcaatcgggaagaagatgcctgacaccaaaggaaaaagaaaaacaacataaatcaaataacgctgataaaatggcttgttttgttcatggtcatgctcgtgatcatggccgcacccgcaatcatggtcatggtgatgtccgcttttttcaggcgacttgataaatagatatgcttggacggcggtcagaatggccagcaggaagatcgcaataaaggaaagataggcatatttcatattgatatattttgttagatttcctgaggcatgcagatgataaaagaaaaacgtaaatcccatcagcaccaataaacgaaacatccaatcacccctttaccagtagtgatcccgctaaaacaatcacgacaatgtatgtaatcagcaggaaaacaaatcgttttttgaaggccgcaagcatcatcaatagattcttaatatccaccattgcgccaaagacgagaaaggcgattaacgatcctaatgaaaatgtgctgctgaaggaagacgcgatgaacgcatcaacttctgaacaaagcgacaggacaaacgccagacccatcatcacgagggaagaggatacatcattctgcccgatcgcaagcagagtggatgttttgacatacgtctgcatagcggctgcgataaaggcgccgaggattaaatatttccccacggagaaaaattcatcaatggcatgccgcaaggtcccgcccagtttttggagcaaggtgccgtgatgatgatggtggtgcccgggttcatcaggctttaaaagctggttatccttaaattgataggataaaatgaccccgatgatcagcgaaacggcgagagccagtccgcctctgtaaaagaccacgctccatctattcccgaacgcaatataagtagaaaataaaacgataggattaatgataggcgcggtcagcatgaaagcaacgcccgcatgcagaggaactccctttaacagaagccgcctcgtaatcgggatgatgccgcattcgcaggcgggaaataaaacgccggccagcgcaccgaataaaacggcgagaaaacggtttttcggcatgattcttgcaatcatttcttcagaaacaaacatttgaatgattccggaaagtatgacgccaatcagaataaacggaatggcttctattaaaatgctgataaaaatagaattcagctgaagaaaagatgattgtgctgtcacaataaaacctccgctcatgttaagctgcctttcttatgataccagaaaaaaaggcactgcttgtttgacggaggaagggaaaggatcgtttcactttggttaggattccaaaaaaccgagtaggatactgtctgtttctgcagcttcttttccgagccaaatcaggtgtccccatgagtgaagcaaacagagaacagcgccacgaatgtgctcttttgcatgatgtgcatgtgacaagtcaaccaatccatcataaacactttgcataatcagcacgggacatatgatggcttgcaggtcttttaaagagacagcggcggtttgagacaagtcaatcagaaatccttcacccgagcgctgccggctgttcattttccgaaatgcttctatgtctttttcattcatcaaggacttgattcgctgaaacggaagcgtgctgaatttggggctcatagctcgaaacatcaaacgcgggaaagcgttattcaaggaagaaatcagcttccatatccacttttccaccggcgggcggaagagaattctccccaatttatattcagtgtcttttggggtgagccactctttggtgaccgcggattgcagggtcaatgtatttactctttccggataatgtgaggcaaagcatatgccgctcggccctcctgctgagatggcgatcacatggacactgtcgatttgtaaatgatctaataatttcacatagaaacggcaggcgttggcaagactttttccaatttcttttgacgttcgtccatagccgggccttgaaggcgtaatgatggaatacccttgctcaatcaacgctgtgtatccgaattcctcgtaacaatttgaatgcccgccatgcatgacaaggatcggagttcccttgcctgtcacagaatattctagtgtactgccatcgaaggtgatcgtttcgactcgtcttttcatctgtttcacccaattggtttttgcctattatagagttttcagcaattgaccacaaggagaagaaatgaataaacaaaggcccttgaatatgatatactttgtattgatattcattctcaattaaaactttgatatagatgtgaacgggaggcaggacggatggctgagaatcaagaggtatatgacgttacgattataggcggggggccgattgggctgtttactgctttttactgcgggatgcgggagctgaaaacaaaggtaatcgaatttttgccgaagctcggagggaaggtgtctttattctttcctgagaaaatcattcgcgatatcggcggcataccggggattgcgggaaagcagctgatcgagcagctgaaggagcaggcggcaacatttgatcctgatatcgtattgaatcagcgtgtgaccgggtttgaacgcctgaatgacggcaccattgtactgacgggttctgaaggggaaaagcactatacaagaactgtgattttggcttgcggcatgggtacacttgaggtcaatgagtttgacagcgaggatgcggcccgatatgcgggcaaaaatcttcattatggagtggagaagctcgatgcgtttaaagggaaacgcgtggtgatatcaggcggcggagatactgcggtcgattgggctaatgagcttgaaccgattgcggcgtctgtgactgtcgttcatcggcgtgaggaattcggcggaatggaaagcagcgtgacgaaaatgaagcaatcatcggtgcgggtgcttacgccttatcggctggagcatttgaacggagatgaagagggcatcaaaagcgtgaccgtttgtcatactgagtctggccagaggaaagacatagaaattgatgagctgatcattaatcatggcttcaaaattgatctagggccgatgatggagtgggggctggagattgaagaaggaagggtgaaagctgacagacatatgcgaacgaatcttccgggcgtgtttgtggcgggcgacgcggctttttatgaaagcaagctgagattgattgccggcggatttacggaaggcccgacagcggtcaacagtgccaaggcttatctggaccctaaggccgagaatatggcgatgtattccacccatcataaaaaattggtgcataaataaaacagcccttgaggaaaagggctgcttgccatcaggtgtgaaggagttttttctctgcatgttgattgtggatgaaagctagcaattcatcctgttcttgtacggctgtgaatccataaatgccggcagctgagtcatcgcctatgcagacgataggagggcggcttgctgacggttccggcaaaatgccaatttgttcgccaccattgatcaattgctgaacggacagcttgtttgggcaaatgaccatgtgcagcggggattcactgatggtacgctgaatcatgtgggtgaaccggtcatctatgacgttttcatgagtgatataaaacgaacaggattcatgcttttgcatgttttccactgcatggcggctcccgacaacaagacgtttctctgaatcaggctgaatggcggtgacaagaaagccccgtttctcaagctctgtctttgcttgctcagatgctgcactcagtttggctgtcagctggcggatgtcgattttctgagaagccagtgctctgaaaaattcacaaaccgcccggcgcgatgtgaaaaaaacgtcttcaaaggtgccaatctttcgaagaatgtcttcattgacaggcatgttttcggtccgccatttcggccactcgatgagatcggcgccggaatcgcgcagcttgtctgcaagcgggtcttcatcttcgccatgagtcacaaccatcaaatgccgtccgatgagcggtttgctttcaaaccagctgtgtgtttgaaagttgacgatgtctccgatgacgataatcgcagggtttgtaatctggtgttcctgcactttttgctgaatgttctcaagtgttcctttcacactccgctggcggccccacgttccccattggatgacaatgacagggacagaaggcgatttcccgtatgaaataagctgctggcaaatataagacaagttcttgacacccatgtaaaaaacaagggtttgaacgcttcgggccagcccttcccagtcaaggttcggcgtgccttttaatgatttatcatgcgctgtaatcatggcaaaagacgatgcgaaatcccgatgcgtgacggggatgcccgcatatagcggcgctgcaattccagaggtgattcccggcaccatttcatagcgaatgccgtgctcatgaagagcatctgcttcctcgccgactctgccgaatacgctcggatctccgcccttcaagcgaacgacggttaacccatttaatgctttttcaaccagcagggcgttaatttctttttgtttcataaaatggcggtttggcagttttccgcaataaataaactggcagtccggtgatgcaaattcgagcagcttcgggttggcgagccggtcatataaaatcacatctgcttcctcgagcgcctgttttcctttgatggtgagcaggcctgggtcgccgggtccggctcccacgaaatatacgattccgttcttcatgatcatgtcatccttccgtcactgtaaaaaatgaaggaccactagaaaagtgatccggtcttttgatcaatatacgagataaacatgttctccttcgatcagcgtttcatatgttttgacacatccgtggtcaggttcttggacgattccgtcttctaaggaaattttccagtcgtgcatcgggcagaaaacatattgaccgctgacgatgccttctgccaggacgccgcctttatgcggacagcggttttcgatggcgcggatgcttccgtctgaaagcttgaaaaccgcgagctccttatcttcaatatacactgttttgcctaattgttcaggcaattcttcaatttttccgatacatacttttgttacgtctttgtttaccatgcccattcctcctcaatgattgtttttgtcattatgatgtggtcacgacattttcaaataattctttcgaggtttgtttatcctctaaaaagtctttccacggatccttgtggacagagagtgtttcattcattcggtcgttcagctcctgccgcttttccggatcgtttaacacggattggacatgggataaaccgacgcgctcaagccatgcggacgtacgctccagatagtttgcggtttccctgtaatattgcaggtaagcgcctgcgtattctaagacttcttcatttgttttcaccttcatcagcaaatcgccggcacgcaagtgggttccgccgtttccgccgacataaagctcccagcctccgtcgatgccgacaacgccaaggtccttaatgccggattccgcacagtttcgcgggcatgcagacacggccattttgactttgtgcggcgtgtttagcccttcgaattttttctcaagcgcaatgcccagtgccatggagtcttgtgtgccgaagcggcagaattgctcgcctacacatgttttcactgtgcggagcgtttttccgtatgcgtagcccgacggcatatcaagatcttcccataccttcggaaggtcttcttttttcacgccgataagatcaattcgctggccgcctgtcattttcacgagcgggatctcatatttgtcaacgacatcggcgatcttgcgcaaatctgtggagttggtcacgccgccgtacatccgaggaacgactgagtatgttccgtctttttgaatattggcgtgcattcgttcattaacaaagcgggatgtccggtcatcctcgtatttggttggattgatcatgcctaagtagtagttcagagccggccggcatttggaacagccttctggcgttttccagccgagcacattcatgacttctcttgtatgtgacagccctttggctttgatttcttctacgacttcatctcttgacaatgtggtgcagccgcaaatggcttctttttgcgctgacgcatcaaagtctgatccgagcgtatgctggaggatttcttctacgagtggcttacagcctccgcatgagcgggatgcgccagtgcatgctttgatctcgtccgttgacgagcagcccttttcctgtatggcttgaataatcgcaccttttgacacgccgttacagccgcagatgatttcatcgtcgctcatcgctgcggtgatgcttgtgcctgcttcttggttgagaggctgtaagattgatattttagaggtttcagagatatcggcttctttttgaatcatagaaaacaggcgattgccttcgctgctgtcaccgaataaaacagcaccgacaattttgttgtctctcaggacaatttttttatagatgccgtcctgctcatcgaagactttaatcgcttttttgtcctctgattcatcaaagtccccggcagagaaaacctcgacgcccgatacctttaactgtgtggagagaacggagccctcatacgggtttgtttcgatgccgcaaatatgcttcgccagcacttttgcctgttcatagagcggcgccacaagcccgtaggcgattcctcggtgctcggcacattcgccgaccgcgtaaatgtgcgggatttcagtctgcatataatcattgacgatgatgccgcggttaaccggaatgccgctctcggccccgagcgttgtatttgggcggatgccgacagccatgaccactaaatcagcttcaatgcttgtgccatccttgaaacggaggccttcgacacgatcgtcaccaacaatttcttcggtttgcttttcaagtaaaaaggtcataccttgtttttctaactcgttttgcagcaggcgtcctgccgttgcatcaagctggcgctccatcaggaatggggcgaggtggatgacggacacgtccatgccaagattcagcagtccgcgagcggcttccaaaccaagaagtcctccgccgatgacggctgcttttttatattgttttgacgcggtgagcattgtgtctgtatcttttatgtcccggaaagctgtgacgccttttttgtctgcgcccggaatcggaaggataaaagggagcgagcctgtcgccaggatcaattcgtcgtaaggctggattctgtctgcatctgtgatgactgttttgttttccgtgtccactttgatgactgtttcatttgtatacaattgaatgttgttttcttcgtaccagtcccaatcgtttaacgtaatatctttaatatctgtatcgccttgaagcacttttgacaaaaggattcggttgtaattgggatgcggttcggctccgaaaattgtgatctgaaactcgtctttagcaacactcagtatctcttcaatggcccttaccccggccattccattaccaacaagaactagctgtttttttcccatcagatgatccgctccttatcaatgttttttccagcgtagcacagcaaaaaggaatatttaagatacatgttataaaatgtaacaaaatatacgaaaagttctaaaaattttatgaaaaatttaaataggtctgattcggacggcgcataccttaaaaccgggcattttacaggctggatctaaggcttccccgattaaatcattcacattttgagcgtctgcccaatggatgggaacaaaaacagtatcttttctgatttgttctgataatttgctgcggacggtgatgcttccccgcggcgattctatttttaccagcacacggtcctcgatattgtaggttgctgctgtttgcggatggatttcgataaacgattcaaaatgtctcgcggtaagggcggcgctttttcttgtttggacgcctgttaagtagtgagacatgactctgcctgttgttaaataaagcggataatcggctgtcggcttctcttttggaacaggtggctcgtttggaatcacacttaatgccgctttttgatccggatgagcaaatgattctgtaaacaagcgtccaattccgggatgatcaggttccggacacggccaatgaatgccgccttcacgtctgagcctgccgtatgagatgcctgaataatcggcaatcccgcctcggctcgcttctctcaattcatcaaaaatatcctccgctgacgtataagaaaagtagcggcccttgccgagagcggatgcgagatcacaaatgatctgccaatcatgctttgcttcgccgggacatggccggcttgtttctcttaatgtcacgcgtccttctacatttgtcatggtgccttcatcttctaagtaagaggaggcgggtaaaatcacatctgcgtatttcgcagtctcagaaataaacaaatcgattgcaacaaagaatgtcagtttacgtaaagcctttttcacaagattcgcatttgggctggagacagcgggattggagcacatgaggaacaatcctttgatgtcgccgtcattgattttttccatcatttcataggctgagacaccttttcgcggcagatcatcctgatggattccccacactttcgcaacatgtgcccggtgttgttcgttttcaatagatcgatagcccggaagctgatcggctttttggccatgctctcttgcaccttgcccgttgccttgtccggtgatcgccccgtaacctgagtaaggtgtaccgatttttcctgtgatcagcaccatgtttaagaagcctttcacagccgctgttccatcggtttgctgttcaatcccgcgggctgtaaacagcatgccggacgtttccttggcaaactttacagccgcttttcttatatccgccagggggacactcgtctgttcggcgatgtcattcaggtccaacgagtcagtatgctgcttcagctcttcgaatccatttgttcgtgattgaatgaaatcctcgtttataagctgttcgtcaatgatgattttgacgagaccgttggcaagggcggcgtctgtgccgggtttgattttcaaatgaagatcggcgatttttgttgtcgctgtttcacgcggatcaatggcaatgatgtaagctccgttttctttcgctttttcaaaatatggcataatcgtaggctggcactccgcgatattggtgccggccagaatgatcacacgggtgtggggaatgtctgataagggattcgttaagcctctgtccgcgccgaatgtttggttggctgcggttgctgcggcggacatacaaagcctcccgttgtagtcgatgtattttgtctgtaagcccacccgtgcgaatttccctaacaaatacgcctcttcatttgtaatcgaggcgcttccgtataccgccatagcgtcatggccgtgttctacttgtatcattgtcacttggtctttaatgtaattcagtgcttcttcccaggaaacaggcataaactcgccgtttttcttcagcagcggccgggtgatgcgggaggagttcagggcatgctggtgggcgttcatgcccttcatgcatagccgaccctgtgttgtaggattatcaatcccaatcgcagtgtactttttgcgcgtgacgatggtttgttccacgagctgcattttgcactgcatgctgcaaaacgggcattgagtgtcatatgttttttctgattggacgtcttgctgtttatcacggaaatatctaagcagtcgttcagtcaaaatgcctcatcctttcttatatgcacccgtctctacagtcgggttttgaatcagtgacagatctgtttggaggctttccagcagctgtgcccttaggtcttcttcgaatagcacttctctgatatgaacgatcccgagacggtctatccactgatgaacaccttctaagtaatgagccgtttcccgataatactggatcagtcctttgatcatgccggcagtgctgtcttcgttctcagtcacgcaaaacaaagctcctgaacgggcatgagttccccggacgccgccgatgtgaatgtcccagccagcttgtctccgaattgcgccgacatcttgcagggcggcatcggtgcagtctgtttcacatgataagctgatagaaatgggagcgggtaagggaagcatctcaagttgtctttcgatttgggctgccagctgctgaattgatcgattttgcccgcatgtacatgctttgatgctttgcagcgcgtgtcggtgttcattagtgtaaacgggcatcttcaggtctttttttatgttcgggagatccgcaggcttgatcccggaaagcttcagcctttggccgtgagtgatggatacgtcgggaatgctgtatgcctcaatgatgttggcgatggttcttagctgctccgcgtttgtccgcccgccgtacatttgcgggatcaggatgcatgtctcttcagtggctggctcaggctggacaaacccagggtacagcatttccagatagtattgaatcgcaggaacacaagtactgcatccgttttttgttttccagtcaagctggttcatcacttctgccggattagtgaatggcctgcgctgaagctcagcgatgatgtcgtcttctgtaaaatcagtacagctgcaaaacgaaggtgtgccggcgggcttcgtatattcgctgttggtcatgtgcctcaaaaggtcttcaacgagcggtttgcatcctccgcaggacccagtggctttggtgcagtgcttgacttcctcaacagttgttaagctattcgtgtgcaccgcttcttcaatcgcgcctttcgtcactgtgttgcattggcaaatcgtttcactggaaggcatggattcaaataaagggccgcttgtctccggttcgatgatctgctttttgacaatggagatgtctcgttgtttaaggaggctgtcgagaagccgctgcttgtcacgggtgtctccgaataaaataacgccggccagtttttcatctacaaaaagcgcttttttataaacgcctgcttgttcgtcgtagattttgatgctcgtcgtgcgttcatcctcttggatctttcctgctgaccacacatcgattccagctatttttaacgccgctgatggtgctgagccttgatattcctcacatggaacgccgcaaatatgactggcgagcgcttttccctgctcataaagcggagccaccaatccgtacaccgttccgttatgctcagcgcattcaccaacggcgtagatattcggttcgcttgtctgcatgaagtcattcacgatgatcccgcggttcactttgattccagcggatacagccaattcaatattcggtttgacgccggccgccatcacaatcaagtctgcttttaatgaagagccatctttaaaatggattcggtctgccttcgtggcgccggaaatggagacggtgtctttctccaaaagaaaggttaggcctttttgttccagctctgtttgcagcagccgcgccgctgtttgatcgagctgtttttgcataatgccggcggagtggtgaatgacgctgacatccataccgagatgctgtaaacctactgcagcttccagtcctaataagccggctccgattaccgcagccttttgaaagtgctgggccatgttcatcagcgcttggcagtcttctattgtccgaaatccatagacaccttttttgtctgccccggggatagggagaatatgaggggaggagcctgttgccactattaatttgtcatacgacagagtgcgtttccgatctgtgatgacctgctgctgatctgtatcaatctgaataaccgtttcgcctgtgtaaagcgtgatcccgtgcttgtcgtaccaatccttgctgttcagtgtaatatcatcgagtgacgcttcaccctgcaatacagaggataagagaatgcgattgtaattgggatgcggctcgcttccgaaaatgacaatctcaaacatgtggcgattcagctttaatacttcttcaatacagcggattccggccatgccgtttcccgctaacactaatctttgtttcttcatgtatcagacctcctttggcgaagctcgtaagttttctcctattaaaaattatgtcacaatgcattgttaacgcattaaacgtgtcacaaaaacttacacatgtcttttccagaaaataatggtcctatatccttgattcagaaaatgtaaaataatgagggtctagaaaggggaatcttatgaagctgtcggaactgaaaactagcggtcatccactcactttgctctgttcctttttatactttgatgtcagttttatgatatgggttatgcttggggcgctgggtgtttatatttctcaggattttggcctgtctccttttgagaaagggcttgtcgtagctgtgccgattttatctggatctgtgtttcgtatcattcttggtattttaacggacagaatcggaccgaaaaaaacggcagtgatcgggatgctggtgacgatgattccgctgctttgggggacattcggcggccgttccctgactgagctgtatgccatcgggattctgcttggcgtggcgggagcaagctttgctgtagcgctgcctatggccagccgatggtatccgcctcatttgcaggggcttgcgatggggattgccggagcggggaacagcggcacgttgtttgcaaccctgtttggccctcgtctggcggagcagttcggctggcacattgtcatgggaattgcgctaattccattattgatcgtctttattctttttgtatccatggcaaaggattcccctgcacagccgtctccccagccgctcaaaagctatctgcatgtgttcgggcaaaaggaaacatggtttttctgcctgctgtacagcgtcacatttggcggatttgtcgggctctcaagctttttatctattttctttgttgatcaataccagctgtcaaaaattcacgcaggggacttcgttacattatgtgtggtggcggggagctttttccggcctgtcgggggcttgatttcggatcgtgtcggcggcacgaaagttctttctgtattgtttgtcatcgtggcactgtgtatggccggagtcagcagcctgccatctctttcaatggttattgttctattgtttgtcggaatgatggggctcggaatgggaaacggcgcagtattccagctcgtaccgcagcgttttcgcaaagaaattggcatggtgacgggaatcgtcggtgcggccggaggaatcggagggtttttcttgccgaacatcttaggatctctcaaacagatgacaggcacatatgctatcggttttatcacgttttcctgtatcgcgctgctggcgtttgcacttgtgcttgccgcaggctattactggcggaaaagctggagcgcggaaagcagcccggcggatgtttaggattttgacggacacgcgtttgtgcgtgtcttttttattttctcttgattttcaacagtgaaccgatcaaaataaatagtaattattacgatttgttagtgagaggagttttctgaatgaatcaacatacgctgctcccgaaaaaaacggagcgtcttcaatactttggatcggtcagtccgatcaaaggcgagaaaccagtggaaaaagagaaaatgaaggacctgcaaaatatcaggaaggattatttttttgacattcagcatgtaggtgtagctaatgtgtcccatccagtcacaatcacttctgccatgatgcctgccgagcaaacaacggctgcgaactttacaatgacttgtaatttgccgagaaatcagaaggggattaacatgagccggttaacagagctgctgcaagtctatcatcaaaatggctggattctctcattttcctctcttcagcaatttacgaaagagcttgcagaaaacatggacacatcatctgccacagttgaagtgaggtttccgtggtttttcgaacggaaaagcccgaagcttgagaaagcgggtttgatgcatgctgatatattcatgtctgtcacctatcgcaaagatcagccgtttaaacagcgtgccggcatctcagcaaaagtaacgactctgtgcccttgctccaaggaaatcagcgaatacagtgcccataatcagaggggaacggtcagcatttgggcggatattcacccggccgcatcgctgccaagtgatgttaaagctgatttgcttcacgccgcagaatcaaatgcttctgcgagactgcatccggtattgaagcggcctgatgaaaaagccgtgacagaaacggcctatgaaaacccgagatttgttgaggatctcgcccggctgattgctgcagatttgtttgagcttgaatgggtgtcagcctttgagattgaatgccgaaatgaagaatcgatccatcttcacgatgcctatgcgaagctgtgtttttcgaaggaagtggataaaatatgaaactctcattattcattattgcagttcttatgccagtcatcctgctgtcagcctgctccgatcatgcagaagaacacgcaagtatcaatacaaagaaaacggtcgaaaacataacggacgttcgaaaaacagcaaaaacaagcattgattggacaaagccttcgggcggagaatacccggatattaaacagaagcatgtctggattgatgtgaatgtgaaggagcagaaggcttacatcaaggaaggaagcaacaccatctatacaatgatgatttcttctggtcttgatcaaacaaaagatgatgctacgccaaagggcaccttttatgtagagcctgaacggggagaatggtttttctccgaaggataccaggaaggcgcagaatactgggtatcatggaaaaatcacggtgaatttttatttcatagtgtgccaatgactaaggatcaaaaagtcatcaaaacggaagcagaaaaactaggaacgaaagcatctcacggatgtatcaggctgaccattccagatgcgaaatgggtatatgaaaatatccctgaacatacaaaagtggtgatcagctgaattgaaaaccgttgacaaaaaggaaaaaagaccatacaatttaaatcgtaactattacgttttgtgataaatggcttatcattggctgtatctgtgaaaagcggaaaggcnnnnnnnnnnnnnnnnnctgtcggcaagggcagggatttgcgatggggaaaaaggattaaacgcggttggagcctttacggatttagaaatcgggcggcagtgagaaatgagcgcgaaaagctgctctacaccattgtacatacggcaaagtatacaatttaaatcgtaatcattctattttaatggaggcattattatgaaaaaaattccggttaccgtactgagcggttatctaggtgcgggaaaaacaacattgctgaacagcattctgcaaaatcgcgaaggcttgaaaatagcggttatcgtaaacgatatgagcgaggtgaacattgacgcgggcttggttaagcaggaagggggcctttccagaacagatgaaaagcttgtggaaatgtcaaacggctgcatttgctgcacgcttcgcgaagacttattaattgaagttgagaagctggcaaaagacggacggtttgattatatcgtcattgaatcgacaggaatcagcgaaccgatcccggtggcccagactttctcttatatcgatgaagagatgggaatcgatcttacaaaattctgtcagctggatacgatggtgacggttgttgatgccaaccgtttttggcatgattatcagtcaggcgaaagccttctggaccgcaaagaagcattgggggaaaaggatgaaagagaaatcgccgacctcttgatcgatcaaattgagttttgcgatgtactgatcttaaataaatgtgatttggtcagcgagcaagagctcgaacagcttgaaaacgttcttcgtaaactgcagccaagagccaggttcattcgttccgtcaaaggaaatgtaaaaccgcaggagattttgcatacagggttatttaacttcgaggaagcgagcggatcggccggctggattcaagagctgacggcaggccatgcggaacacaccccggaaacagaagaatacggtatctcttcatttgtgtataagagacgtttgccgtttcattctacacggttttatcattggttggatcaaatgccaaagaacgtggttcgtgccaaaggaatcgtctggtgcgcatctcataacaaccttgctttactgatgtcgcaagcaggtccgtcggttacgattgagcctgtatcatattgggtggcggcgctgccgaagcttgagcaggagcaagtcaaacagcaggaaccggaaatcctggaggagtgggacccggagttcggcgatcgcctaacgcagctagtttttatcggaactgacctggatgaagaaacgattacgaaagagcttgatcaatgcctgctgactgaatatgaatttgattccgactggtcgctgtttgaggacccgtttaaatggaagctgaatcaatagaaaaaaagccgtcccctggggaacggcttttttaatgaaacgtttgtttaaacataatgagcgtattttttctcaaggatattctgaaagaccgcggcaatggagcagatggcccaataaatgagagcggtcagaatatacatggtcatataatcaaactctctgcccccgatgattttcgcatgctggagcaattccggcactgtaatcatcgcagcgagagaggacgccttgattaagtcgagcaatacattggcaagcggaggcagcgcaatacgtatcgattgcggcaaaatgatgcccctcatcgtctgccaataggaaagacccagcgaggatgcggcttcccactgtcctttttcgacggatgaaatggctgaacggttaatttccgcaatgtaggcggcgctgtttaggctaaagccgattaaagcagccgtgacagcggaaaattcaatgccgatataaggaaacccgaaataaaggataaacaaaatcaccaaaatcggaacgccccgcataaatgagatatagagcttcgccggccatctgaacaaagcaaggttagacattctggcgagtgatatgaacaggccgatcacagttcccgcaaacatgcttacaaaagagatgagcagtgtatacccaatgccttttatgacataagggaacgattcaatagccagctttgtgttgaaaatatattcccattgaatgctattgatcatggcgtccgattacaaatcaacgtcctgaacgtcggcatcaattttttttgatacatctgctttattgaagaattgtttcgacagtttagtcaaagagccatccttgctcatctctttcaatgcttcgttcatttttttctgaagtgccgcattgctttttttcatgacaagggcctgtttgttcggcatgtacttgatgtcaggatgaattgtaatgttgagatccgggaatgccgcgagcgcaagtgtctgcaggtaatagtcgtttaaaatgacgtcagtgcgtccgttggcaacatcttttaaatattgctcatttgtcgcattatcataaatcacttctttggcgccgtattttctcgcgacctccatgtagacggttgtagccgcgccagccgctttcttcccttttaaatccttaagcgttttaatccctgataaatcgtcttttcggacaattgccgtgccgtatgaatatttatatggagtggaaaatgcgaacttctcctcacggtccttcgtgacatcgatgtcatttgcggctgcgtcaacctgtccgctgttcaccgctgtcagcatcccgtcaatgcccatctccttgaactcaaccttcagccccaatcgttttgccgcttcacgaacaacttcaacctcgtagcccgtcagcttatcagagccagagtcagtatcgtgataagaagtgggatagagcgtacctgatgtagcgactacgattttccctttgtccttgatttgctcccagcctgtatccttggaatcggcttcatttttgccggaacaggctgccaatataagaaagaaagccattgtgaaactgaatataacggctttggaatgcatgaatgatttcacctatagttcccccaatctgttaatcaactaaaaagatagcattgaacataaggggttgcaatatgttgatcgcgttttcaaaaagttcgaattgtgtatacaaaaggcatggatgggtgtttaaaagcgtctatgaagggaagaggtgatgaaaaaaggagttgtccaaggatgaatgccagacgtaccaaggaaacacatgtggacgtgaaggatgcagcagatccgtcattcatctatgccaataccgtaagaaatggtcaagaagcatgaaatcgatcttcagaataaattaaagtcttgctgatgcccctaaggcatatgatatattcgatgagaaagaaaacggaaacatttaaaccataatgggggagtcaaatgaatagttacaaaccagcctgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttgttctgctgtattctattttgctgccggtgttttggcgcggttatcttatcggaaaaaggatctgcggaatcagaatcgtaaaaaaagacggatcacacgttagtctgttaacaatgttttaacaggttattgtagccggcctggtttactgtataaccttcggactcggcttgatcgccagcctgattctgattgccgtacgagaagacaaacggaccctgcatgatttaatcgcgggaacgtatgtcacttatgcgacaccaggtgaagaagaacttaatgctgacgaagagattagaaagagcgaataatggttcgctctttttatttttatgcataaaaaatacaaggcagcaaaacatatgaaaaataggattggaggaataaactggatgaaacgaataaccatcaacatcatcacaatgttcattgcagcggctgtcatttctctgaccggtacagctgaggccgctgaaaaacagcagcagcctcccgcaaatgttacactgacagatcagcaaaagaaagagattgaacaactggaagcagagattcttaaaaagcgcaaagacgtgatctcaaagtatgtacaatatggtgtcctgcctaaagaaagaggagaacacatcaaaaatcacttggacaaacactttgaaatgatgaaacaaaacggctttgttccaaagcaccattctcatccgcataaatttgaaaaaagacattaaaatggtaagcatccaatgggaattgggtgcttttnnnnnnnnnnnnnnnnnncaatattagctgagctgttccgcgactaacatcgagttgatctgaaacgcgtttcatagcctatgataggtttatcaataattcaggagtgataaacactatgatccaccagcatccagaatcttttccgaaacattttttgtggggctctgcttctgcagcgtaccagattgaaggcgcttggaatgaagatggcaaaggcccttctgtttgggatgtgtttacgaaaataccgggcaaaacgtttaaaggaaccaatggcgacattgcggttgaccattatcaccgatttaaagaagatgtcgctctgatggctgagatggggttaaaagcgtatcgattttccgtcagctggccacggatttttccaaaaggaaaaggagagatcaatgaagcaggtctagcgttttacgatagactgattgatgaattgctttctcatcacatcgagccggttctgactttatatcactgggatttgcctcaagcgcttatggacgaatacggcgggtttgaatccagaaacatcatagaggattttaatcactactgtattactctttataaacgttttggagacagggtgaaatattgggttacgttaaacgaacagaactacaattttaatcacggatttattacagccatgcatccgcctggagtgaaagacagaaaacgattttacgaagcaaaccatattgcgtttctggctaatgcaaaagccatcgaatcatttagagaatatgtgcctgaaggcaaaataggtcctagctttgcttattctccggcttaccctttatcaagccatccagaggatatactggcatttgaaaacgccgaagaatttacgaacaattggtggcttgacatgtattgctggggaacctacccgcaaattccattccgctacttggaaaaacagggatgggcgccgacaattgaaccaggagatatggacctgctcgccaaagggaagcctgattttgtaggtgtcaattattatcagacgatcacctatgaacgaaatccgcttgatggtgtgtcagaagggaaaatgaatacgacaggccaaaaaggaaccaatcaggagacggggatacccggagtgttcaaaacgaaaaaaaatccgcatctgacaacgagcaactgggattggacaattgacccaattgggctgcgtatcggtcttcgccgaattacaagccgctatcagcttccagtgtttataacagagaacggtttgggtgaatttgataaagttgaagacggcactgtacaggatgattatcgaattgattatttgcgttcgcatcttgagcaatgcagacaagccatcagtgacggtgtcgatttaatcggctattgcagctggtcgtttactgatctgttaagctggctgaacggctaccaaaaaagatacggatttgtatatgtcaatcgtgatgaagaaagcacatccgatttaaaacgcttgaagaaaaaaagcttttattggtatcaagatgtcatcaagacaaacggagaaagtttataaagagtccctgagagttattctctcaggggtttttcattacacagaaacagcatcaataatataagtgtcggcgtgcaaatctgacatttcagccggcacagtccagcatgtcaattgatagtctcctttaggcagatcaaaggacagtcttttagacatgatgctttcaatatgaattccgttttctgtgacatgaaaaggaacagtcacttttttttcgtaggagtttactgtttctgaactgttcaggcgcaaaagaataaaggcctttgtatttcgctgtgcctcaaaggaaatggctccgtctgccgcagcatatcctttttcaatcgcttcgtcagtccaatccattacaggaggtgtagaatccttttgaaatacagtaaattgatgatatgaaatcgaaagttcttgcggcttccatgatttgatcaatgtgctgttcctcctctatgtactgtttactgaattgtgaataaaacctttgtgccgtctgggtaatcggtaagctgatgcccgacccaagagcctgctccgcggttgtcagcgggagaaatgtattctacagaagctccctcaccgccttctttgcacatggccattggccattcatctctgtcatacccctttttggaaggtacgtcctttaatgattgctcgcggcgttcctcagctccgtctctgtcgatagtgcacacctctgagtgcccctcatttatcgcatccttaatatgcttggccgtttcgggataacggtcagaagggaaggcgattgtttcatcatattctttcgtttgagacgttttttgatcagctgagaaaaagtctccttttatcaggccgacagctgcagctgctatgatgacgatgacgagaagtattgtttttatgatgtccgtcgtgatgttcacctcccgcttttaaaactgacacaagagtaatccagaaagcatttggtgtaaaggtttaaattttatgttttacgctcagtttattgcagaaatcgtaattttagcagatcgaaatatttgttttaagcaaaatacgattgccaatttacaataatgatagtaagtcatcagccgtttgcggcttgattaatcattttaaattggcttatgataccggtaagctcttcagctaattgagaaagtgtttcagaagctgcggtaatctcctccattgcagcaaactgctcctctgttaatgcagccgcttgccgggtatttttagtagattctttaatgtcggccgtattggctgcaaaggaatcatttatatgatgtgcactggctgaaatgtttgttacagatgctgataaatcactaatctcggcgctgatttcacctgttgcagctgcaatttccttaaatgcatctctggtgcgctggatcatggtgactccttctgcagcttctgttttcacatgctcaacagatcttgcagaccgattcatatccttttgtatttctatgatcagttttgaaatctgtcccgcagactgttgagactcttccgctaatttacgtacttcatcagcaacaacagcaaagccttttccttgttcaccggctctggcagcttcaattgctgcattcagcgcaagcaggtttgtctgatcggcaatttgggtgatgaccgataaaatttgctcaatttgtttagagcggccgtctaactggtgtatgatttctccgcttttctgaattgactggtgaatcgcatccatttgcgcctgtacatttgcaatttccttttgtccaatgtctgcttttgattgcgcgagctgccctttgtcagcgatagcggcagtatttgcagaaatatcccggatgtctgctgaagcttgttttaaagagctttcactgttttcaattcgggtgatctgatcttgggctccatttgcaatctgctgtacagcttctgtgattttttctgaagcttgatttgtttcctctgctccggctgagagttgctgagaggctgacgcaagctgaagggctgattgttgtacggtttgtatggtatcgttcagcttcattctcatcttattataatagacgcttagttctgaaagctcgtcaccggttttgtctgacacctctattgtcatatctccgtttccggcactttcaaaggcgctttttaaagcgttcagccgcttgttgatttttctggtgaaaaccaaaacaaggatgactgatactataatgacgataacaagaacgatagcgaattgagtgaaaagtgattgtgtaagtgatgctaaaatactttgattagctccggtatacagcatgccgatgatgttcccattttgatcttttaacggcatgtatgcagtctgataagaagaacctgctacatctgcttgtccgtaaaaacgctttcctttctttaaaacagcggcgataacttcagaagaagcctgggtgccgacagctctttcgccatttttcatgacattggttgcaacacgagtatcgccttggaaaatggtaatggtatcacctgttttttcgccaagcagatcaacaatatcttcatttccattgatttgtgtttgccctttatagagcttattgtttttcacctgccagtcgcctgacatgacatcatcaatatatgtgctgcttaaagcgagatcacctttcgctttttcagttgccatttgtttcatgctttctgtaatttctttaagcatcacagtgccaactgatgccgaaaacaaaagaatcaccacgaaaacgaggcaaagaattttagttcctagcttcatcttaaatcgttttatcaacataattcctccttttatgatttataggtcatattacttatcgggtttttgggtttaaagttttatttttaaaaaaataaaaccggcctgattttcaggccggttgtgtgatgctattcaaggtttgcgtggtgagtgaacatagtttcagaatcgagtgcttttttctccatgagttttaaaatcactgcatcatagaagagcagcaaagtttgttcaaataatgatcccattggctgaatggttttatagcttccgtttgactggtctttaggagaaccaggcattctgatgatgaggtccgcttgttttccgatgcttgattccggattgatggttaaagcggcaacaattccgtgtaagctttttgcttttgctgcggtatgaatcaagctctttgtctcgcctgatcctgagccgataataactagatctccttcggcgagcggcggagtgagaatctcacctactatatgggcgttgaagcccatgtgcatcagtctcatcgcgaaggattttgccatcaggccagaccgacccgcacccgcggtgaaaatttggtgggatgacagaatgtgatcggcaagctggtcagcctcttcattagaaatataagctgctgaattgtgtaactcattgagaatttccgctacgtattcagtcgttttcatagaagttatccttggacaatcagctgcttcatttttgaagctgtttccgccttatcagctgcgcttgtaattccgcccccaacaatgacaaggtcagggttttgcttgatcacttctggcagtgtatcaagtttgatgccacccgcgattgcggtttttgcgttttttacggtgtttttgattgtcgttaattcttcgaaagagtttttgccctctgcttgaagatcatagccagtgtggacgcagatgtagtcaacaccgagtgcgtcaatttctttcgcacgggattcgatatccttcacgttaatcatgtccactaagattttcttcttttgttttttggcttcttctactgcgcctttaatcgttgcatcgtctgtagcccctaaaacggtgatgatgtcagcgcctgcttccgacgctttcataatttcgtagcctccggcatccatgattttcaggtctgcaagaaccttcaattgaggaaatgcttcttttatttctttaacggctcttaggccttcattaatgacgaccggtgttccgatttcaactacgtcgatgtattgttctacctctttgacgagctcaatggcttccgggatgttgacgaggtctaatgcaagctgtaattccattgttgatccactccctttttcgaattatttttcattctataggttctcttatttgatgagaagtaggcactttgaagtcaacaagttacttggaggatactgtgaggagagacaatcagatttctttcgcttgattttatgagtgagtataatgaaaaaagagtctgcaaaaaagtaagtaagtgatgatacgtatctaacatacaaaaaggttactaaggggggattctattgagccggatggacgacaaaaggtttaattgtgagaaggaattaacgcttgcagtgattggcggtaaatggaaaatgctcattttatggcatttaggaaaagaaggcacaaaacggttcaatgaattaaaaacattgattcctgatattacgcagaagatcctcgtgaatcagctgagagagcttgagcaggatatgattgttcacagggaagtgtatccagttgtcccgccgaaggttgaatattctctgaccccgcacggagaaagcctcatgcctattcttgaagccatgtatgagtgggggaaaggctatatggaattgattgatatcgacaaaaatgtcatgaaagaatcgttgtaagacgctcttcgcaagggtgtctttttttgcctttttttcggtttttgcgcggtacacatagtcatgtaaagattgtaaattgcattcagcaataaaaaaagattgaacgcagcagtttggtttaaaaatttttatttttctgtaaataatgtttagtggaaatgattgcggcatcccgcaaaaatattgctgtaaataaactggaatctttcggcatcccgcatgaaacttttcacccatttttcggtgataaaaacatttttttcatttaaagtgaacggtagaaagataaaaaatattgaaaacaatgaataaatagccaaaattggtttcttattagggtggggtcttgcggtctttatccgcttatgttaaacgccgcaatgctgactgacggcagcctgctttaatagcggccatctgttttttgattggaagcactgctttttaagtgtagtactttgggctatttcggctgttagttcataagaattaaaagctgatatggataagaaagagaaaatgcgttgcacatgttcactgcttataaagattaggggaggtatgacaatatggaaataactttttaccctttaacggatgcacaaaaacgaatttggtacacagaaaaattttatcctcacacgagcatttcaaatcttgcggggattggtaagctggtttcagctgatgcgattgattatgtgcttgttgagcaggcgattcaagagtttattcgcagaaatgacgccatgcgccttcggttgcggctagatgaaaacggggagcctgttcaatatattagcgagtatcggcctgttgatataaaacatactgacactactgaagatccgaatgcgatagagtttatttcacaatggagccgggaggaaacgaagaaacctttgccgctatacgattgtgatttgttccgtttttccttgttcaccataaaggaaaatgaagtgtggttttacgcaaatgttcatcacgtgatttctgatggtatctccatgaatattctcgggaatgcgatcatgcacatttatttagaattagccagcggctcagagacaaaagaaggaatctcgcattcatttatcgatcatgttttatctgaacaggaatatgctcaatcgaagcggtttgaaaaggacaaggcgttttggaacaaacaatttgaatcggtgcctgaacttgtttccttgaaacggaatgcatccgcagggggaagtttagatgctgagaggttctctaaagatgtgcctgaagcgcttcatcagcagattctgtcgttttgtgaggcgaataaagtcagtgttctttcagtatttcaatcgctgctcgccgcctatttgtacagggtcagcggccagaatgatgttgtgacgggaacatttatgggcaaccggacaaatgcgaaagagaagcagatgcttggcatgtttgtttctacggttccgcttcggacaaacattgacggcgggcaggcgttttcagaatttgtcaaagaccggatgaaggatctgatgaagacacttcgccaccaaaagtatccgtataatctcctaatcaacgatttgcgtgaaacaaagagctctctgaccaagctgttcacggtttctcttgaatatcaagtgatgcagtggcaaaaagaagaggatcttgcctttttgactgagccgattttcagcggcagcggattaaatgatgtctcaattcatgtaaaggatcgatgggatactgggaaactcaccatagattttgattaccgcactgatttattttcacgtgaagaaatcaacatgatttgtgagcgcatgattaccatgctggagaacgcgttaacgcatccagaacatacaattgatgaattaacactgatttctgatgcggagaaagagaagctgcttgcgagggccggcggtaaatctgtgagctaccgtaaggacatgacgataccagagctgttccaagaaaaggctgaactgctttctgatcatccagcggttgtatttgaagatcgcacattgtcctatcgaacgttacatgagcaatctgcacgcatcgccaatgtgctgaaacagaaaggggttggcccggacagtcctgtcgcggttttgattgaacgctctgaacggatgattacagctatcatgggaattttaaaagccggcggagcctatgtgccgattgatccgggttttcctgctgagcgcattcaatatattttggaggactgcggggcggatttcatcctgactgaatcgaaggttgcggcgcctgaagccgatgctgagctgattgacttagatcaggcgattgaggaaggtgcagaagaaagcctgaatgcagatgtgaacgctcggaaccttgcctacattatttacacatcgggaacaaccggacgcccgaaaggcgttatgatcgagcatcgccaggttcatcatttggttgaatctctgcagcagacgatttatcaaagcggcagccaaaccctgcggatggcattgcttgcgccgttccactttgatgcgtcagtgaagcagatcttcgcgtcgcttcttttgggccaaaccctttatatcgtaccgaagaaaacagtgacgaacggggccgcccttactgcatattatcggaagaacagcattgaggcgacggacggaacaccggctcatttgcaaatgctggcagcagcaggcgattttgaaggcctaaaactgaagcacatgctgatcggaggagaaggcctgtcatctgttgttgcggacaagctgctgaagctgtttaaagaagccggcacagcgccgcgtttgactaatgtgtacgggccgactgaaacgtgcgttgacgcgtctgttcatccggttatccctgagaatgcagttcaatcagcgtatgtgccgatcgggaaagcgctggggaataaccgcttatatattttggatcaaaaaggccggctgcagcctgaaggcgtggcgggtgagctttatatcgcgggagacggtgtgggccgaggctatttacatttgcctgaattaacggaagagaagtttttacaagatccattcgtgccgggcgatcgcatgtaccggaccggggacgtggtgcgctggcttccagatggaacaatcgaatatttaggcagagaggatgaccaggtcaaagtccgcggataccggattgagcttggggaaattgaagccgtgattcagcaggcgccagacgttgcaaaagccgttgttttggcacgccctgacgaacagggaaatcttgaggtttgcgcatatgttgtgcagaagcctggaagcgaatttgcgccagccggcttgagggagcatgcggccagacagcttcctgactatatggtgccggcttactttacagaagtgacagaaattccgcttacgccaagcggcaaagtcgaccgccgcaagctgtttgcactagaggtgaaggctgtcagcggcactgcctatacagcgccgcgaaatgagactgaaaaagcaatcgcagccatttggcaggacgtgctgaacgttgagaaggcggggatttttgacaatttctttgaaacgggcgggcattcattgaaggccatgacccttttaacaaagattcataaggaaacaggcatcgagattccgcttcaatttttgtttgagcatccgacgattgcggctcttgcagaggaagctgatcacagagaaagcaaagcttttgcggtgattgaacctgctgaaaaacaggagcattacccgctttccctggcacagcagcgaacatatatcgtcagccagttcgaggatgcgggagtcggctacaacatgccggcagcagcaattctggaagggcctttagatattcaaaaactggagcgcgcatttcaggggttaatccgacgccacgagtcattgagaacatcatttgttcttgaaaacagcacgccgagacagaacattcacgatagcgttgatttcaacatcgaaatgattgaaagaggcggccgctcagatgaggcaattatggcttcattcgttcggacatttgatttggcgaaagctccgctgttcagaatcggtttgctggggcttgaagagaaccgtcatatgctgctgtttgacatgcaccatttgatttctgacggtgtatccattggcattatgctggaggagttagcacgcatttataaaggcgaacagcttcctgagcttcgtctccagtataaggactacgctgtatggcaaagcagacaggctgctgaagggtacaagaaggaccaggcttattggaaggaagtctttgcaggcgagctcccggtgcttcagcttctgtccgattacccaagaccgcctgttcaaagctttgaaggggatcgggtgtcaatcaagctggatgcgggggtaaaggatcgcctcaatcgtttggctgaacaaaacggcgccactttatatatggtgatgctgtccgcttactatacgcttttgtcaaagtatacggggcaggatgacatcattgtcgggacaccgtcagcgggcagaaatcactccgatacagagggcattatcgggatgtttgtcaatacgcttgcgattcgcagtgaggtgaagcaagatgagacgtttacccaattgatctcgcgtgtccgcaaacgggtgctgaatgccttttctcatcaggactatccgtttgagtggcttgttgaagatttgaacatcccgcgtgatgttagcaggcatccgctgtttgacacgatgttcagccttcaaaacgcgacagagggcattccggctgtcggcgatctgtccttgtctgttcatgagaccaatttcaagattgccaaatttgatttgaccgtgcaggcgagagaaaccgatgaaggcattgagcttgatttggattacagcacaaagctgtttaaacaaagcacggcaaacaggctgcttacgcattttgcgcgtttgcttgaagatgctgcggctgatccagagaagccgatttctgagtataagcttctttctgaagaggaggccgcttcgcaaattcagcagtttaacccgggcagaacaccttatccgaaagataaaacaattgttcagctgtttgaggagcaagcggcgaatacgccagaccacactgcgcttcaatatgaaggcgaatcactcacttatcgtgaactgaatgaacgggccaatcgtttagcccgcggcattctttctcttggagctggcgaaggcagaactgcggctgtcttatgcgagcggtcaattgatatgattgtgtcgatcttggcagtattaaaatcaggttcggcttatgttccgatcgatccggaacatccgattcagcggatgcagcatttcttccgtgacagcggagcaaaggtgcttctcactcagaggaaattaaaggctttggcggaagaagcggaatttaagggcgttatcgtgctagccgatgaggaagaaagctatcatgccgatgcgcgaaatctcgcactgcctcttgattctgcagcaatggccaacctgacgtatacttctggaacgactggaacacctaaggggaatatcgtgactcatgccaatattctccgcacggtgaaggaaacgaattatctcagcattacagaacaggatacgattctcggtctttccaattacgtgtttgacgcgtttatgttcgatatgttcggctctttgttaaacggagccaagctggtgctgataccgaaggaaaccgttttggacatggctcgcctgtcccgcgtcattgaacgggagaacatcagcattctcatgattacaaccgctttgttccacttgcttgtggacttgaatccggcatgcttgtcaacgcttcgcaagattatgtttggcggggaacgggcttcggttgagcatgtcagaaaagctttgcaaacggttggaaagggcaagcttcttcacatgtatgggccgtctgaaagcacggttttcgcgacgtatcatccggttgatgaattggaggagcacactctgtctgttccgattggaaaaccggttagcaatacggaagtatacattcttgaccgtacgggacacgtgcagcctgccgggattgccggagagctttgcgtcagcggcgaaggtctcgtgaaaggctattacaaccgtccagaactgactgaggagaaatttgttccccatccgtttacatccggcgaacgcatgtataaaacgggagaccttgcgagatggctgccgaatggcgacatcgaatttatcgggcgaatcgaccatcaggtgaagattcgcggacagcgcatcgagcttggagaaatcgaacatcagctgcaaacccatgatcgtgttcaggaaagtgttgtgcttgccgttgatcaaggagcgggagataaactgttgtgtgcttactatgtcggagagggagacatctcatcacaagagatgagagagcatgctgcgaaggacttgccggcatatatggttcctgcggtgtttatccaaatggacgagctgccgctgacagggaacggaaaaattgaccggagagcgctgccgattcctgatgccaacgtttcaagaggtgtttcatatgttgcgccacgcaatggaacggaacaaaaagtcgcggacatttgggcacaggtacttcaggcagaacaagtcggcgcttatgaccacttctttgacattggcggacattcattagcaggcatgaagatgcttgccttggttcatcaggaactgggcgttgagctgtcactcaaggatctcttccagtcaccgacggttgagggcttggcacaggtgattgcctccgctgaaaaagggacagccgcaagtatcagcccggcagagaaacaagatacgtatcctgtttcttcaccgcaaaaacggatgtacgtgcttcagcagcttgaggatgcgcaaacgagctataacatgccggcggttctgcgcctgacaggtgagcttgatgttgaaaggcttaacagcgtcatgcagcagttaatgcagcgtcatgaagccttgagaaccacgtttgaaataaaagatggagaaacggtgcagcggatctgggaaaaggctgagtgtgagatagcctatttcgaagccccggaagaagagatagagcggatcgtttctgagtttattaagcctttcaaaatcgaccaacttccactgttcagaatagggcttatcaagcattcagacactgagcatgtgctgctgttcgatatgcatcatattatttctgatggtgcatctgtcggtgtgctgattgaggagctttcaaagctgtacgacggagaaacccttgagccgctccgtattcaatataaggattatgccgtgtggcagcagcagttcattcagtctgagctttacaagaagcaagaagagcattggctgaaggagctggacggagagctgccggtgctgacgcttccgaccgattacagtcggcctgccgttcaaacatttgagggagaccgcattgcattttcattagaagcaggcaaagctgatgctctgcgcaggcttgcaaaagaaacggattccacgctttacatggtgcttctggcttcatacagtgcatttttatcaaaacttagcgggcaagacgatatcatcgtcggttcacctgtggccggacgatctcaagcggacgtcagccgcgtcatcggaatgttcgtcaatacattagcgttgcgcacgtatccgaagggtgaaaagacgtttgctgactatcttaacgaagtgaaagaaacggcactcagcgcttttgatgcgcaggattacccacttgaggatttgatcggaaatgttcaggttcagcgtgacacaagcagaaatccgttattcgatgcagttttttcaatgcaaaatgcgaatataaaggatttaacaatgaaagggattcagcttgagccgcatccgtttgaacggaaaacagccaagtttgacctcacgctgacggctgacgaaaccgacggagggcttacattcgtactcgaatacaatacagctctgtttaagcaggaaacgattgaacgatggaagcaatattggatggagcttttagatgcagttactgggaacccgaaccagccgctttccagcctgtcactggtcactgagacagaaaagcaagcgcttcttgaggcatggaagggcaaagcgctgtctgtgccgacagacaaaacggttcatcagctattcgaagagactgtccagtgccacaaagaccgcccggctgtcacatacaacggccagtcttggacgtacggcgagctgaatgcgaaggcaaaccgtctcgcgcggattctgatggactgcggcatcagcccggatgaccgcgtcggcgttctcacgaagccgtcgcttgaaatgtccgccgcggtgctcggcgtcttgaaagccggagcggcgtttgtgccgattgatcctgactacccggatcagcggattgagtatattttacaggacagcggcgcgaagctcctcttgaaacaggaaggcatttcagtgccggacagctatacgggagatgtcattcttctcgacggaagccgcacgattctaagcctgccgcttgatgaaaacgacgaggaaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagtagaggaccgcagtgcgaagtacgcgggctttgggttcgacgcttccatttgggagatgttcccgacctggacgatcggtgctgaacttcacgtcattgatgaagcgatccgcctcgatatcgtccgcctgaacgattacttcgaaacgaacggcgtaacgatcacgttcctgccgacacagcttgcggaacagttcatggagcttgagaacacatcacttcgcgtattgctcactggaggagacaagctgaagcgggcagtgaaaaagccgtacacactcgtcaacaactacgggccgacagaaaatacggtcgttgccacgagtacagaaatccatccggaggaaggctcgctttccatcggaagggccattgccaatacgagagtatacattctcggagagggcaatcaggtgcagccggaaggcgtagccggagagctttgcgtggcggggcgcggactggcacgcggctatctgaatcgagaagacgaaaccgcgaagcggtttgtcgctgatccgtttgtgccgggtgagcgcatgtaccgcaccggcgatttggtgaaatggacgggcggcggcatcgaatacatcggccggatcgaccagcaggtcaaggtccgcggctaccggatcgagctctcagaaattgaagtccagctcgcacagctttctgaggtgcaggatgcggcggtgacagctgtcaaagataaaggcggcaatacagcaatcgcggcgtatgtcacaccggaaacagctgacatagaagcactgaaatcagcactgaaggaaaccctgccggattacatgatcccggcgttctgggtgacgctgaacgagcttccggttacggcaaacggcaaagtggaccgcaaagccttgcctgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaannnnnnnnnnnnnnnnnnnnnnnnnnnnnnnnnnnnnnnnnnnnnnnnnntcgaagagcttacccaatatgtagagcgtgccgaaggcaaacaggcagaccaaggcccggtggagggcgaagtcatcctgacgccgatccagcgctggttctttgaaaagaacttcacgaacaagcaccactggaaccaatcggtgatgctttacgccaagaagggctttgatcctgaacgagtggagaaaacattgcaggcgctgatcgagcatcatgacgcgctccgtatggtctatcgtgagggacaggaagacgtcattcaatacaacagaggtcttgaagctgcttccgctcaattggaggtcatccagattgagggccaagctgcagattacgaagaccgtatagagagagaagcggagcgtttgcaaagcagcatcgacttgcaggaaggcggcttgttaaaagcaggattgttccaagcggaagacggagaccacttgcttcttgccattcaccacttagtggttgacggcgtgtcgtggcggattttactggaggatttcgccgcagtatatacacagcttgagcaaggcaatgaaccggttctcccgcagaaaacacattcatttgcagagtatgcagagagattgcaagacttcgcgaactccaaagcctttttgaaagaaaaagagtattggagacagcttgaagaacaagctgtcgcggcaaagcttccgaaagaccgcgaatctggtgatcagcgaatgaaacatacaaagacaattgaattctcgctgactgctgaagagacagaacagctcaccacaaaggtgcatgaggcatatcacacagaaatgaatgatattttgctgacggcattcggattggcaatgaaggagtggacgggtcaggatcgagtaaatgttcatttagaggggcacggacgtgaagaaatcatagaagacctgaccatttcccgcacagtcggctggtttacaagtatgtacccaatggtgctcgatatgaagcatgcggatgatctgggctaccagctgaagcaaatgaaagaagatatcagacatgtgccgaataagggagtcggatacggcattctgcgctatctgacggccccggaacataaagaagatgtggcgttctcgattcagccggatgtcagcttcaactatttaggtcagtttgacgaaatgtcggatgcaggtttgtttacgagatcagagctgccatcaggacagtcattaagccctgaaacagaaaaaccgaatgcgctggatgttgtcggatatatcgaaaacggaaaactgacgatgtcactggcctatcattctcttgaatttcatgaaaaaacagtacaaacattcagtgacagctttaaagcgcatcttctcagaatcattgaacattgcctatctcaagacggtacggaactgaccccgagtgatcttggtgacgacgatttgacgctggatgagctggataaattaatggaaattttctaatagaggtggcatatgagcaaaaaatcgattcaaaaggtgtacgcactgacaccaatgcaggagggaatgctgtatcatgcgatgcttgatccgcattcttcctcgtacttcacacaattagagcttgggattcacggcgcttttgatcttgaaatctttgagaaaagcgtcaatgaactgattcggtcatacgatattctccgtacggtatttgtgcatcagcagctgcaaaaaccgcgtcaggtcgtgttagcggaacgcaaaacaaaggtgcattatgaggatatcagtcatgcagacgagaaccgccagaaagagcacattgagcgttacaaacaagacgttcagcgccaaggctttaacctggcaaaagacatattgttcaaggtagcggttttccgccttgatgcagatcagctgtatcttgtctggagcaatcatcatattatgatggacggctggagcatgggcgtcctcatgaaaagcctgttccaaaactatgaagcgctcagagcaggaaggacacctgcaaacggtcaaggcaagccttactccgactacatcaaatggcttggaaaacaggacaatgaagaagcggagagctactggagcgagcgcttggcgggttttgaacagccaagcgtgctcccgggccgcctgcctgtaaaaaaagacgaatacgtcaataaagaatattcctttacatgggacgaaacactggttgcccgcattcagaaaaccgcaaaccttcatcaagtgacagggcctaacctatttcaggccgtttggggcattgttctcagcaaatacaactttacggatgatgtgatcttcggaacggtcgtctcgggacgaccgtctgaaatcaacggaatcgaaacgatggcggggctgtttatcaacaccattccagtgcgggtgaaagttgaacgagatgctgcattcgctgatattttcacagctgttcagcagcatgcagtagaggcagagcgttacgattacgtgccgctctatgagattcaaaaacgctcagcccttgatggcaatctcttaaaccatctggtcgcgtttgaaaattatccgcttgatcaagagcttgaaaacggcagcatggaagaccgcctcgggttttcaattaaggtagaaagcgcatttgaacaaacgagcttcgatttcaacctgattgtgtatccaggcaaaacatggaccgtcaaaattaaatataacggagccgcctttgattccgcttttatcgaacggacagcggagcaccttacccgtatgatggaagcagctgtcgatcagccggccgcttttgtgcgtgagtacgggcttgtgggagacgaagagcagcgtcaaattgtcgaggtgtttaacagcacgaaagccgaacttcctgaaggaatggctattcatcaggtgtttgaagagcaagcaaaacggacgccggcgagcactgccgtcgtatatgaaggaaccgagctgacgtaccgcgagctgaatgcagcggccaaccgtctggcgagaaagcttgtcgaacaaggtcttcaaaaaggggaaacagcagcgattatgaacgaccgctcagtagaaactgttgtcggcatgctggctgttttaaaagcaggcgccgcatatgtgccgcttgatccagcgcttcctggggatcgtcttcgtttcatggcagaggacagctccgttcgaatggttttgatcggaaattcttatacagggcaggcacatcagctgcaagtgccggttcttacactggacataggctttgaagagagcgaagcggctgacaatctcaacctgccatccgccccgtctgatttggcgtacatcatgtacacatccggttcaacgggcaaaccgaaaggcgtcatgatcgaacataaaagcattctgcgcctcgtcaaaaatgccgggtacgttcctgttactgaagaggaccgcatggcgcaaacgggagctgtcagctttgatgccggaacgtttgaggtattcggcgcactgctgaatggcgcagcgctttatccggtcaaaaaagagacgctgcttgatgcgaaacaatttgctgcatttctgcgtgagcaaagaatctcgacgatgtggctgacatcacctttattcaaccagcttgctgcaaaggatgcgggtatgttcggcacactgcgccatttaatcatcggcggagatgcccttgtcccgcatattgtcagcaaagtaaaacaggcatcgccgtcgctttcattgtggaacggatacggcccgacagaaaacacgacgttttcaaccagttttctgatcgaccgtgagtatgggggctctatcccaatcgggaagcctatcggaaattccactgcctacatcctggatgagcagcaatgcctgcagccaatcggcgcgcctggtgagctttgcgtaggcggaatcggtgtagcgcgtgggtatgtcaatctccctgagctgacagagaagcaatttctcgaagatccgttcagaccgggtgagagaatttatcgcactggtgacttggcaagatggctgccggacggcaatattgaatttttaggcagaatcgacaaccaagtgaaggtgcgcggcttccgaattgagcttggcgaaattgaaacaaaactgaacatggctgagcatgtgacagaggctgcggtgatcatccgcaagaacaaagcagatgaaaatgaaatttgcgcgtacttcacggcggatcgtgaagtggctgtgagtgagctgagaaaaacactgtctcagtctttgcctgactatatggtccctgcccacctgattcaaatggacagcctgccgctcacgccaaacgggaaaatcaataaaaaagaactgcctgcaccgcaatcagaagccgtgcagccggaatacgcagcaccagaaacagagagtgaaaagaaattagcggagatctgggaaggaatactcggcgtcagagcaggcgttaccgataacttctttatgatcggcggtcattctttgaaagcgatgatgatgacggcgaaaattcaagagcattttcataaggaagttccgataaaagtgctttttgaaaagccgactattcaagaactggcactgtatttggaagagaacgaaagcaaggaggagcagacgtttgaaccgatcaggcaagcatcttatcagcagcattatcctgtatccccggcccagcggagaatgtatatcctcaatcagcttggacaagcaaacacaagctacaacgtccccgctgtacttctgctggagggagaagtagataaagaccggcttgaaaacgcgattcagcagttaatcaaccggcacgaaatcctccgtacatcgtttgacatgatcgacggagaggttgtgcaaaccgttcataaaaacatatcgttccagctggaggctgccaagggacgggaagaagacgcggaagagataatcaaagcatttgttcagccgtttgaattaaaccgcgcgccgctcgtccgttcgaagcttgtccagctggaagaaaaacgccatctgctgctcattgatatgcatcatattattactgacggaagttcaacaggcattctaatcggtgatcttgccaaaatatatcaaggcgcagatctggaactgccacaaattcactataaagattacgcagtttggcacaaagaacaaactaattatcaaaaagatgaggaatactggctcgatgtctttaaaggcgaactgccaatactggatcttcccgcggatttcgagcggccagctgaacggagctttgcgggagaacgcgtgatgtttgggcttgataagcaaatcacggctcaaatcaaatcgctcatggcagaaacagatacgacgatatacatgtttttgctggcggcgttcaatgtactcctttccaagtacgcgtcacaggatgatatcattgttggctcgccgacagctggcagaacacatcctgatctgcaaggtgtgccgggtatgtttgtcaacacggtggcactcagaacggcaccagcgggagataaaaccttcgcgcaattccttgaagaggtcaaaacagccagccttcaagcgttcgagcaccagagctatccgcttgaggagctgattgaaaagcttccgcttacaagggatacaagcagaagtccgctgttcagcgtgatgttcaacatgcaaaatatggagattccttcattaagattaggagatttgaagatttcctcgtattccatgcttcatcatgttgcgaaatttgatctttccttggaagcggtcgagcgtgaagaggatatcggcctaagctttgactatgcgactgccttgtttaaggacgagacgatccgccgctggagccgccactttgtcaatatcatcaaagcggccgcggctaatccaaacgttcggctgtctgatgtagatctgctttcatctgcagaaacagctgctttgctagaagaaagacatatgactcaaattaccgaagcaacctttgcagcactttttgaaatacaggcccagcaaacacctgaccattctgcggtgaaggctggcggaaatctgctgacctatcgcgagcttgatgaacaggcgaaccagctggcgcatcatcttcgtgcccaaggggcaggaaatgaagacatcgtcgcgattgttatggaccggtcagctgaagtcatggtatccattctcggtgtcatgaaggcgggggcagctttccttccgattgatcctgatacacccgaagaacgaatccgttattcattagaggacagcggagcaaaatttgcggtcgtgaatgaaagaaacatgacggctattgggcaatatgaagggacaatcgtcagccttgatgacggtaaatggagaaatgaaagcaaggagcgcccatcatccatttccgggtctcgcaatcttgcatacgtcatttatacgtccggtacgaccggaaagccaaagggcgtgcagattgagcatcgcaatctgacaaactatgtctcttggtttagtgaagaggcgagcctgacggaaaatgataagactgtattgctttcatcttacgcatttgaccttggctatacgagcatgttccctgtacttctgggcgggggcgagctccatatcgtccagaaggaaacctatacggcgccggatgaaatagcgcactatatcaaggagcatgggatcacttatatcaaactgacaccgtctctcttccatacaatagtgaacaccgccagttttgcaaaagatgcgaactttgaatccttgcgcttgatcgtcttgggaggagaaaaaatcatcccgactgatgttctcgccttccgtaagatgtatggccataccgaatttatcaatcactacggcccgacagaagcaacgatcggcgccatcgccgggcgggttgatctgtctgaaccggatgcatttgcgaaacgcccgacaatcggacggccgattgcgaatgccggcgcgcttgtcttaaatgaagcattgaaacttgtgccgccgggagcgagcggacagctctatatcacgggacaggggcttgcgagagggtatctcaacaggcctcagctgacagccgagagatttgtagaaaatccatattcgccgggaagcctcatgtacaaaaccggagatgtcgtacgaagactttctgacggtacgcttgcatttatcggccgggctgatgatcaggtgaaaatccgcggctaccgcattgagccgaaagaaattgaaacggtcatgctcagcctcagcggaattcaagaagcggttgtattagcggtttccgagggcggtcttcaagagctttgcgcgtattatacgtcggatcaagctattgaaaaagcagagctccggaagcagctttccctaacactgccgtctcatatgattcctgctttctttgtgcaggttgacgcgattccgctgacggcaaacggaaaaactgacagaaacgctttgccaaagccgaacgcggcacaatccggtggcaaagccttggccgcaccggagacagcgcttgaagaaagcttatgccgcatttggcagaaaacgcttggcatagaagccatcggcattgacgacaattttttcgatttaggcggccattcattaaaagggatgatgctgattgccaacattcaggcggaattggagaaaagcgtaccgcttaaagcactgttcgagcagccgactgttcgccagctggcggcttatatggaggcgtctgctgtttcaggcggccatcaagtcctcaaaccggctgacaagcaggctatgtatccattgtcatccgcacagaaacggatgtacgtgctcaatcagcttgaccgccagacgataagctacaacatgccatctgttcttctaatggaaggagagcttgatatttcgtgcctgcgcgattcactcaatcagcttgtgaaccgtcacgaatcattgcggacgtcatttatggaagctaatggtgagcctgttcagcgcatcattgaggaggcggaggttgatcttcatgtgtttgaagccaaagaagacgaagcggaccaaaagattaaggaatttatccggccattcgacttaaacgacgcaccgctcattcgcgcagctttgcttcgaatagaagcgaaaaaacatttgctgcttttagatatgcatcatatcatcgcagacggcgtctcaagaggcatttttgtaaaagaattggcgctgctttacaaaggagagcagcttccgcagccggcgcttcattataaagatttcgccgtttggcaaaatgaagctgagcaaaaagaacggatgaaggagcatgaggcgtactggatgtcagttctttcaggcgagctgccagagcttgatctcccgctcgattacgcccgtccgcctgtgcaaagctttagaggagatacgatccgtttccgtacggaaagtgagacggcaaaggcggtagaaaaactgcttgcggaaaccggaacgaccttgcacatggtgctccatgctgttttccacgtctttttaagcaaaatttccggacagcgggatatcgtcatcggctccgttactgccggcaggacgaatgctgatgttcaggacatgccgggaatgttcgtcaatacacttgccctgagaatgaaagcgaaagaacagcaaacatttgcggagcttttggagcaagcaaagcagacgaacctgtcagcgcttgagcatcaggagtatccgtttgaagatctggttaatcagcttgatctccctcgggatatgagccgaaacccattgtttaatgtgatggtgacgacagaaaaccctgataaagaacagcttacattgcaaaatctgagcatttcaccttatgaggctcatcagggaacttctaagtttgatctgacactgggcggatttactgatgaaaatggcattggcttgcagctcgaatatgcgacagatctgttcgcgaaagaaacagctgaaaaatggagcgaatacgttctgcggctactaaaggctgttgcggataacccgaaccagccgctttccagcctgtcactggtcaccgagacagaaaaacaagcacttcttgaggcatggaagggcaaagcgctgcctgtgccgacagacaaaacggttcatcagctattcgaagagactgtccagcgccacaaagaccgcccggctgtcacatacaacggccagtcttggacgtacggcgagctgaatgcgaaggcaaaccgtctcgcgcggattctgatggactgcggcatcagcccggatgaccgcgtcggcgttctcacgaagccgtcgcttgaaatgtccgccgcggtgctcggcgtcttgaaagccggagcggcgtttgtgccgattgatcctgactacccggatcagcggattgagtatattttacaggacagcggcgcgaagcttctcttgaaacaggaaggcatttcagtgccggacagctatacgggagatgtcattcttctcgacggaagccgcacgattctaagcctgccgcttgatgaaaacgacgagggaaatccagagacggctgtaaccgcggagaacttggcgtacatgatttacacgtctggaacgaccggacagccgaagggtgtcatggtcgagcaccatgcgcttgtgaacctgtgcttctggcaccacgacgcgttcagcatgacagcggaggaccgcagtgcgaagtacgcgggcttcgggttcgacgcttccatttgggagatgttcccgacttggacgatcggcgctgagcttcacgtcattgatgaagcgatccgcctcgatatcgtccgcctgaacgattattttgaaacgaacggcgtaacgatcacgttcctgccgacacagcttgcggaacagttcatggagcttgagaacacatcacttcgcgtcctcttgaccggaggagacaagctgaagcgcgcagtgaaaaagccgtacacgctcgtcaacaactacgggccgacagaaaatacggtcgttgccacaagcgcagaaatccatccggaggaaggctcgctttccatcggaagggccattgccaatacgagagtatacattctcggcgagggcaatcaggtgcagccggaaggcgtagccggagagctttgcgtggcggggcgcggactggcacgaggctatctgaatcgagaagacgaaaccgcgaagcggtttgtcgctgatccgtttgtgccgggtgagcgcatgtaccgcaccggcgatttggtgaaatgnnnnnncggcggcatcgaatacatcggccggatcgaccagcaggtcaaggtccgcggctaccggatcgagctttcagaaattgaagtccagctcgcccagctttctgaggtgcaggatgcggcggtgacagctgtcaaggataaaggcggcaatacagcgatcgcggcgtatgtcaccccggaaacagctgatatagaagcactaaaatcaacactaaaggaaaccctgccggattacatgatcccggtgttctgggtgacgctgaacgagcttccggttacggcaaacggcaaagtcgaccgcaaagccttgcctgagccggacatcgaagcgggaagcggagaatacaaagcgccgacgaccgacatggaagagctgcttgccggcatctggcaggacgtgcttggaatgtctgaagtcggtgtcaccgacaatttcttctcgcttggcggagattccatcaaaggaattcaaatggcgagccgcttgaatcagcacggctggaagctggaaatgaaagatctcttccagcatccgacgatcgaagagcttacccaatatgtagagcgtgccgaaggcaaacaggcagaccaaggcccggtggagggcgaagtcatcctgacgccgatccagcgctggttctttgaaaagaacttcacgaacaagcaccactggaaccaatcggtgatgcttcacgccaagaagggctttgaccctgaacgggtggagaaaacattgcaggcgctgatcgagcatcatgacgcgctccgcatggtctatcgtgaggaaaacggggacatcgttcaggcgtataaaccgatcggtgagagcaaggtcagcttcgaaatcgtggatctgtacggctctgatgaagagatgctgagaagccagattaagattctcgcgaacaagctgcaaagcagtctcgatctgagaaccgggccgcttttaaaggcggagcaatatcgcacagaagctggggatcacctgctcattgctgtacaccatctcgtggtcgacggtgtgtcatggcggattttgcttgaagactttgcttcaggctacatgcaggctgagaaagaagagagccttgtcttcccgcaaaaaacaaactccttcaaggactgggcggaagaactggcggcattcagccaatcagcgcatcttttacagcaggctgaatactggtcgcaaattgccgctgaacaggtttctcctttaccgaaggattgtgaaacagagcagcggatcgtcaaggatacatcatccgtcctatgtgaattaacggaagaagacactaagcatcttttaacagatgttcatcagccatatggaactgaaatcaacgatattcttctcagcgcgctcggtttgacaatgaaagaatggacaaagggggccaaaattggcattaaccttgagggacacggtcgggaggacattatcccgaatgtgaatatctccagaacggtcggctggtttacggcacaataccctgttgtgctcgacatatctgacgcagatgcctcggctgtgatcaaaacagtcaaagaaaacctgcgccgcattcccgacaaaggtgttggctacggcattcttcgttatttcacagaaacagcggaaacaaagggcttcacaccggagatcagcttcaactatttgggccaattcgacagtgaagtcaaaaccgatttctttgaaccgtccgctttcgatatggggcgccaagtaagcggagaatcagaggcgctgtacgcattaagcttcagcggcatgatcagaaacggccggtttgtgctttcctgctcctacaatgaaaaggagtttgaaagagccacgattgaagagcgaatggaacggtttaaagaaaacctcctgatgctaatccgccattgcacggaaaaagaagacaaggaattcacaccaagcgactttagcgccgaagaccttgaaatggacgagatgggagatatctttgacatgcttgaggagaatttaaaataaaacgcaagggaattacagaaggcgggagcgaaacatatgagtcaatttagcaaggatcaggttcaagatatgtattacctatcgccgatgcaggaagggatgctttttcatgccatcctgaatcccggccaaagcttttaccttgaacaaatcacgatgaaagtaaaaggcagcttgaatatcaaatgtcttgaagaaagcatgaatgtgatcatggaccggtacgatgtatttcgtaccgtgttcattcacgaaaaagtaaaaagacctgtccaagtcgtattgaaaaaacggcagttccatatagaagaaatcgatctgacacacttaacgggcagcgagcaaacagccaaaatcaatgagtacaaagaacaggataagatcaggggttttgatttgacgcgggatattccgatgcgggcagccattttcaagaaagctgaagaaagctttgaatgggtgtggagctaccaccacattattttggacggatggtgcttcggcatcgtcgtacaggatctatttaaggtatacaatgctctgcgcgaacaaaagccgtacagcctgccccccgtcaaaccgtataaagactacatcaagtggcttgaaaagcaggataaacaagcatcactgcgttactggcgcgagtatttagaggactttgaaggacaaacgacgtttgcggagcaaagaaagaaacaaaaggacggctatgagccgaaagagctgctcttttcactgccggaggcggaaacaaaggcctttaccgagcttgcaaaatcgcagcataccactttaagtacggcgctgcaggcagtctggagcgtattgatcagccgctatcagcagtctggcgatttggccttcggtacagttgtttcagggcgtcccgcggaaatcaaaggcgttgaacatatggtcgggctgtttatcaacgttgtcccgagacgtgtgaagctgtctgagggtatcacatttaacggcttgctcaagcagctgcaggagcaatcgctgcagtctgagccgcaccaatatgtgccgctttatgacatccaaagccaggccgatcagccgaaactgattgaccacatcattgtttttgagaactatccgcttcaggatgcgaaaaatgaagaaagcagtgaaaacggctttgatatggtggatgttcatgtttttgagaagtcgaattatgatctcaacctgatggcttcccctggagatgagatgctgattaagcttgcctataatgagaatgtgtttgatgaggcgtttatcctgcgcttgaaatctcagcttctcacagcaattcagcagctcatccagaatcctgatcagcctgtcagcacgatcaacctcgttgacgacagggagagagaatttttgctaaccggcttaaacccgccggctcaagctcatgaaacaaagcctctgacggattggttcaaggaagcagtgaacgtcaatccggatgcgccggcgcttacgtattccggccagaccctgtcttatcgcgaattagatgaggaagcgaaccgccttgcacgccggctgcaaaaacacggtgcgggcaaaggctctgttgtagcgctgtacacgaagcgctcacttgaactggtaatcggcattctcggtgtattaaaggcgggagcagcctatctgccggttgatccgaagctgccagaggaccgaatctcgtatatgctggctgacagtgcggcagcctgtcttctgacgcatcagaagatgaaagaacaagcggctgagctgccgtatacaggcacaacgctcttcattgatgatcaaacacggtttgaagaacaggcaagcgatcctgcaaccgcgattgatcctaatgatccggcatatatcatgtacacgtccggcacaaccggaaagccaaagggcaatatcaccactcatgccaatattcaaggattggtcaagcatgtagactacatggcattctctgagaaagatacattcttatctgtttccaattacgcctttgacgcatttacctttgatttctatgcttctatgctgaatgcggcacggctcattatcgcagatgaacatacgctgcttgatacagaacggctcacagatctgatcctgcaagagaatgtcaatgtcatgtttgcgacaaccgcactatttaatcttctcacggatgcgggagaggattggatgaagggactacgctgtatattattcggcggagagcgcgcgtcagtgcctcatgtcagaaaagcgctgcgggtcatggggccgggcaagctgattaactgctacgggccgactgagggaacagtgtttgcgactgctcacgtcgtgcatgatataccggattccatctcctcattgccgatcggaaagccgatcagcaatgccagtgtttatattctgaacgagcaaagccagctccagccattcggggcgatcggtgaactgtgcatcagcggaatgggcgtgtcaaaaggatatgtaaatcgtgctgacctcacgaaggaaaagtttattaagaacccgttcaagccgggagaaacgctttaccgcacaggggatttagcgcgctggctgccggatggaacgattgaatacgccggccgtattgacgaccaggtcaaaatacgtggacaccggattgagcttgaagaaatcgaaaagcagctgcaggaatacccaggtgtgaaagatgcggtcgttgtggcggaccgccctgagtctggcgatgcatcaatcaatgcctaccttgtgaaccgaacgcagctttcagctgaagacgtgaaggcgcacctgaaaaaacagcttcctgcttacatggtgccgcaaacctttaccttcttggatgagcttcctttaacgacgaacgggaaagtcaataaacggctgctcccaaaacctgatcaggatcagctggcggaagaatggattggaccgcggaacgagatggaagaaacaatcgcacaaatatggtctgaggttctcggcagaaagcaaattggcattcatgacgatttctttgcgctcggagggcattccttgaaggccatgaccgccgcgtcccgcatcaagaaagagctcgggattgatcttccagtaaagcttttgtttgaagcgccgacgatcgccggcatttcagcgtatttgaaaaacgggggccctgatggcttgcaggatgtaacgataatgaatcaggatcaggagcagatcattttcgcattcccgccggtcttgggctatggccttatgtaccaaaatctgtccagccgcttgccgtcatacaagctgtgcgcctttgattttattgaggaggaagaccggcttgaccgctatgcggatttgatccagaagctgcagccggaagggcctttaacattgtttgggtattcagcgggatgcagcctggcgtttgaagctgcgaaaaagcttgaggaacaaggccgtattgttcagcggatcatcatggtcgattcctataaaaaacaaggtgtcagtgatctggacggacgcacggttgaaagtgatgtcgaagcgttgatgaatgtcaatcgggacaatgaagcgctcaacagcgaagccgtcaaacaaggcctcaagcaaaaaacacatgccttttactcatactacgtcaatctgatcagcacaggccaggtgaaagcagatattgatctgctgacttccggcgctgattttgacatgccggaatggcttgcatcatgggaagaagctacaacaggtgcttaccgtatgaaaagaggcttcggaacacacgcagaaatgctgcagggcgaaacgctagataggaatgccgggattttgctcgaatttcttaatacacaaaccgtaacggtttcataaatgaagtgatgaaaggaggagacagccaatgagccaactcttcaaatcatttgatgcgtcggaaaaaacacagctcatctgttttccgtttgccggcggctattcggcgtcgtttcgccctctccatgcttttttgcagggggagtgcgagatgctcgctgccgagccgccgggacacggcacgaatcaaacgtcagccattgaggatctcgaagagctgacggatttgtacaagcaagaactgaaccttcgccctgatcggccgtttgtgctgttcggacacagtatgggcggaatgatcaccttcaggctggcacaaaagcttgagcgtgaaggcatctttccgcaggcggttatcatttctgcaatccagccgcctcatattcagcggaagaaagtgtcccacctgcctgatgatcagtttctcgatcatattatccaattaggcggaatgcccgcagagcttgttgaaaataaggaggtcatgtcctttttcctgccttctttccgatcagattaccgggctcttgaacaatttgagctttacgatctggcccagattcagtcgcctgttcatgtctttaacgggcttgatgataaaaaatgcatacgagatgcggaaggctggaagaagtgggcaaaagacatcacattccatcaatttgacggcgggcacatgttcctgctgtcacaaacggaagaagtcgcagaacggatttttgcgatcttgaatcagcatccgatcattcaaccgtgatcaaaagcggacagcttcggctgttccgctttttttgtgttgaatgccaatttttgcatggtataatagtcgaaatactcaaataaaggcaggtcgaaacatgcgcacgtctcccaggatgaaatggtttgtattgctgtttacgtttgttttcgccatcggaatgaactcattcagaaattcctttcaattttttatgctgccaatggcagatgccttccatgccgacaggtcgctgatctcggtttctgtcagcatttttatgatcacaaccggcatcgtccagttttttgtcggtttttttatcgaccgtttcagtgtcagaaaaattatggcgctgggagctgtctgcatcagcgcaagctttttggtgcttccttattcaccgaatgttcatgtgttttccgccatttacggtgtgcttggcggaatcggctattcctgcgcggtcggcgtgacgacccagtacttcatcagccgttggtttgacacacataaaggtctggcgcttgctattttgaccaatgccaactctgcgggcctgctgcttctctcgcccatttgggctgcggctccgtatcatgccggctggcagagcacctataccattttgggaatcgtcatggcggctgttctgctgccgctcctcgtctttgggatgaagcacccgccacatgcgcaagcggaaactgtgaaaaaatcttatgattggcgagggttttggaacgtgatgaagcaatcccgcctcattcatatcctgtacttcggcgtgtttacttgcggatttacaatgggaattattgatgctcacctcgtcccgatactgaaggatgcgcatgtctctcatgtcaacggaatgatggccgcgttcggggcatttatcatcattggcggattattggcgggctggctgtcagatctcctcggcagcagaagcgtcatgctatccatcttatttttcattcggctgctcagcctcatttgcctgctcattcccattctcggaattcatcacagcgacctttggtacttcgggtttatcctgttattcgggctcagttacacaggcgtgatcccgctgaccgcggcgtcaatttcggaaagctatcaaacaggattgatcggatcgctgttaggcatcaatttctttatccatcaggttgccggagctcttagcgtgtatgcgggcggtttgttttttgacatgactcatggttatttgctgattgtcgctgtgtgcatcgtgtttgtgggtttatcggctgtaatagagctggtgccgtttttagataaacagaaggcaaaagaaacccaccattcaatataaaaggatcagcactgtcaatgctgatcctttttaaatttgagtttttttgtttcggtatttttaaggataatctccttgaatctgttcatctcctcttcggagtgaaaaaaatgtttggggatcgcaatatattggccacttgatgtattgaccctgaagatatttttatattcgaaaacagctgtaatttcatcccaattgaaaatgaggtcatattttttagaacatatacgaattccttcttggttcagagtatatgttcttttggatttcatccgttcgttcttcttgtatgctctggaaaacttcacatatagaagaaggaggagcagcagtgtaaacagaacggacatcacgataatcaacatactgttcataaacaagttaagcgcgtcacttccataaacgatacggggccatccgttaatgaagttaactgcagcaaatatggcgcaaaacaatagaaagtaaaagcatgatatttttgcgatttgataaaaaaagatttctcttacatccttaaaagtgatttctcctggaagattgatactttcactagcatattgaatcatacggtaaacctacacctctaaccatgtttttccttttagtctagcataatttctcatttttttgcaggcataccagggcgctttgtttttttctccagattgatattgctccccaccacgccaatcataatacaaacagccccggcaagatgataccaggccaggctttcgttgagaatcacaaatcctgcaatcatcgtcacaatggtagatacatgattaaaagcgctcattttaaacgcctcaattcgcgacagcgtatagttagacagaaatgaagtgacaagtgaagacagcacgcccaaatacacaatggcgagaacgaagccgggctcccggaacggcagaaaataagtgccgactgttcccgccgatccgtgacgcacaagggcgatggcgttgaagacgacaaagccgatggctgacatgatgtaggtgagctcggtcagcttgaaccgctgcgtcatttttctggcagcagtattgtacatcgctgaggacaaagcggacaataggatcagcaaagacccttttaagctggctgattccacgtcaacgcctttcatcacaaaaataaacatgacgccggcaacggataaaactgtgaatcccttttgcgtccacgttgggcgttcctttaaaacataagcggcaaagaccatcgtgaaaatcggaatggctgcctgaataattcccgcttcagaggaggacgagtacacaaggccgaatgcctgaaagctgaaaaataacgcgggatacagcagggcgagcggcaaaatggcaatgacgtcctttatgcggattgatagctttacccagccgaataagatcgatatagtggccgcagcaaacgcaatggtgaaccgatgcgccaaaatatcaaacggctctgctgtttgcagtgcgatttttacgaatagaaaggataaaccgataatgaacgaatataaaatagccgctatataagcgggggtttgctgatgtttaaccataatgggaagggctcctttacctgaattgcagcgccggtcgctccctttattgtatggccgcggtcagaacggtacaatgagaaaaacaatgaactgtaccggtacaaaacagggggagaaggcatggaaaaatatatgagtctattaacgaggatagaggagatgatgcaaagcaccgcctatcaagaaggagacaggcttccatctatccgtcagctgtccgcccgctaccaagtcagcaaaagcacagtgatccgcgcgctgcaggagctggaaaagcgccaccttatctattctgttccgaaaagcggctattatattgtgaaaaagacagggaaatcaaaaagcgggcagcttggccccatcgactttgccacatctgcgccggatccagatgtgtttccgtatcttgattttcagcactgtatcaacaaagcgattgatacatacaaaaacgatttgtttatttatgggacgccaaaggggcttccatcactcatccgcgtactccgaaagctcttggccactcaacaggtatttgcggatgaacggcatattttcattacatcaggtgtccagcaggcgttatccttgctttgtgccatgccgttcccaaatgggaaagagaagatcgccattgaacagccgggctaccatttgatggtcgaacagcttgagacggtcgggattcccgccatcggggtgaaacgaacagaagaagggcttgatatagccaaggttgagcggttatttcaaacagaatcgattaaatttttttatacgatgccgcgcttccataacccgcttgggtgctcattgtcagagcgtgataaacaggagcttgtgagactggcagaagcgtatgatgtctatctcgttgaggatgattacctcggtgatctggaggaaaataaaaaggcagatccgctgtacgcatatgatctgtcctcacatgtcatctatttgaaaagcttctcgaaaatgatgttccccggcctacgcgtgggggcggctgttttgcccgaagcgctgactgacacgttctatgcgtacaaaaaactgaacgacatcgactgttcgatgatttctcaagcggcattggagatttacctgaaaagcggtatgtatggaaggcataaggagaaaatcagagattcttataaagagcggtcgctgaggctacatcaagccattcgaactcacaggcagctgggaagcggacgctttacgttctccagcgggcaggcaccctgtatgcacacccatctggtgcttcctcaggatctgcccgcctcaagagtgattcatagactgaaaaaacaaggggttctccttgaggcgatagaccgtcattatttatcagattatccgaaagaaaatctattaaaaatcaatatttccaatgtgaaaacggaagatattgagcgcggtgtcaagctgttgatgagccatttataaaagctcttcgtacgagaccattgtgatatcctcagggaaatcagggtgtgcggcgcatacagccattttgtagccgggatcgacctcatacgttttgatatagcatggggaatggctgtccggaagctcaatggatacttgtccgtcctggtgcaggcgcactgaaaaggaatcaagcggaagcgataagcctttgccttcctgtttgataaagctttctttcattgaccatagatgataaaaatagtctgtctgctcgtccttgtcttttgctaaaaggtcgctgtactctgtttttgaaaagaagcgcttggcgatctcaaggctgatcggtttcgttttttcgatatctatgccgatcggctgtgaatcaaacgcaccaatgacccagcggccggagtgagaaatgttgaaatgagcgtcgggaagatcagggatgcacggcttcccgtattcctgtgtgctaaagcggatatcggatttgtccaactgatactgcctgcttatgactgagcgaacgagcacatctcccagcagggtgcggtgagcatcttctttatgataaaatctccggcatttctcccgtttttcaggtgatatgaaagacatgaaccgttcattttcttcctgtgaaagcgggcggtccatataaattccgtaaatcttcattctagatcctccgtctgcaaaagattgtcaaaaccatcctatcatacttccacaagactcatatagaggagaaaataaaaaaacaaagccaaggcggctttgttttagtgtacaggcggagatgctttcacagcggctgtccgccttgccacagcataattcagcagctggattgactggggcaatgaaaagcgcaaaataagtccggtgaggatggcggtcaaaatggtgccaaaaccgatcggcccgcccatgccccatgccgcaaacaaaatggttatttccatgccgttccgcacccattgcacattccagccggttttttctgtaatcagcatcatcagtgaatcacgcggccccgcgccaaggcctgctgatacataaacaccgacgccgtaaccgatcagcaccacgcctagagagaagacgatgatcgagcctgtgtaggtcgagggggcaggcagaatgaaattgaaaaaatctataaatacaccaatgagcaccatattcaggagggccccaattttcggccaagctctcgtaaacaatgacgtgaatccgacgatgagcgctccaataatgatggaccactggccgacggtaagcccgaagtgctgaaacaggctgtaatgaaatgcatcccacggactaatgccgagtgcttttccttctatcgtcagggatacaccaaaagccaaaatgatcaaaccggcaaaataaaatgtccagcgcagaacaagttcttgcttcacgtgaggtcccttctttcgtaaaaatcagtcgattgtcattgtagcacatctgacagaagggcggaataggcgaaaggggctcaacaaaaaaacagggccgccgcaggcgccctgtttcagcgtgttggcaaacccttgcattcgttgtcaggcctgtgcttcggtgctcacgaatttaatattcgctgtgctccaatgctcgcccttcctagacttcaaaggttttcaatcacgctgaaaatcacaaaatcctaaaacgaaaatcgttttaggattttgtcaataatctgaaacagggcgctggcgccctgtttttcttattacagcgggttcaaaatccggttcaagaaccgctgtgtccgttcttcttttggtgcggagaaaatttgctccggcggtccttgctccacgataacgccgccgtcgatgaagatgacttcatccgcaacttcctgcgcgaacttgatttcgtgggtcacgacgaccatggtccagccttcattggccaagtccttgataaccttcagcacctctccgacaagctcgggatcaagcgctgaggtcggttcgtcaaacagcatgagctcaggctgaatcgccagtgcgcgggcgatgccgacgcgctgctgctggccgccggaaagctggaacggatataaatccattttgtccttcaatccgactttatcaagaagctgaatcgcttcttttctgacttcctctttgttccgtttttgcacctgaacagggccctccatcacgttttcgagggctgtgcggtgcgggaacaggtgatacgcctgaaacaccattccggattttcggcgaagctttaggatatccgcctgtttcacctttttggagaaatcgatggagaaatcatcaaatgcaagctctccgcgattcgggatctccagagcgttcaggcagcggagcagcgtcgttttccctgaacctgaaggcccaagtatggcgatgacttttcctttttcaatcttcatatctatcttttttaaaatttcattttcaccgaatgatttgtttaatcctttaacggtaagcatactcggaacctccttatttggccacgtagcggtcaagacgccgttcgatgacatgctggacgagtgagagcaggaagcagataatccaataaataaaggctgcttcaatatagatcactaaaatttgatcaagattccgcgcgccgatttcctgggcttttctgaacagctcagcgaccagaatttgagaggcgagggatgtatctttaatcaggctgataaaggtattggataatggcgggatcgacacacgaaacgcctgcggcaaaatgacgcggaacagcgttttttgatgtgtcatgccaattgtgtagccggcttcccattgccctttcggcacggataaaatagatgcccgaatgatttcagatgcataggcgccgacgtttaaagaaaaggcgataactgcgcttggaaatggatctaatgtgacgttaaaggccgggaacagatagaaaatgatgaacaattgaacgagaagaggagtgccgcgtattgcggatacgtatacgctgaacacccatctcaaaggtctcactttcgacattctggcaagcgccgtaatcagcgccaggatcattccgaatataaaggaaagaatcgtaaggggaatcgtatagtagattccccctgaaagtatcggccagaatgactgctgcaccagatcccacgggatcgccgtgccaagcgtcaatgccggcagattatttagaaacatcttcgccgaaccattttttagaaattttagaaagagtcccgtcctctttcatttcttttaatgctttgttgacttgatcaacaacctcgccgcttcctttacggaacgtgaaatatgttgactgaggatcacctgtttcaaacgcgattttcacgtttttattgccagatgtttttaagtagttcaatacggcaagcttatcgttgtatgtcatatcgacgcggccttgctggatcatttgaagggcctgcgccatgccttcaacgccttctactttagcgccggcatttgtagctaatttgttgtagttgcttgtcagtgattgagctgacgtttttccttttacatctgcttcagacttaatatcgttgttgtcttttttcgttacgacaacggctcttgatgttgtgtatttatctgagaaatcatatttgtcttcacgatctgtttttccgacttggttggcaacaacgtcaaaccgtttggaattcaggccggcaaacatactgtcccactgtgtttccttaaagtcgactttaagcccgaggcgttttgcgacttctgtgataacttcgacatcatagccagtcagtttatcagtgtctttgtcgtggtaagtgaacggctcatatgttccttccgttccgactgtgagcacaccttttttcttaattgaagcccaaagatcgccacctttggcattatcttttgactgattgtcatttcctgctccgcaagctgcaagagctgcaatacttacgaccatgaataaagccaataatgcttttttcatcttattccccacttttctggttgattttattgaaataaaaaaatagcttacaaatctaaaggataacttttttttagtatgagtcaagtaattggttttcataaggcgaaatcttttaaaataaatccaaaaattgctgtgccggtttaggcaaataactgtccgttctccacatgacagccggtgtcataatgaagggattattttcgatatggacggtgtgaacgtgatttctcatatgaacgggaatcattgtgacaggcaaaatagacgcgccgaatccggatgacacgaggctgagcaaagttgcagagtcgtggcattcacaaacaatgcgcggctccaggttcaaacgatgaaattcattcatgacctgattatagacgccttttccgttgacaggccgcagcaggatcagcggaaatgaaggaatgtccaccatcttaatggtgtctccgcacggatatccggcttcatctgaaagcacgagcacacatggaatgtcatcaagctgcttgaattgtactgtgtcacttttgatcagtgttgtcgtgaccgccgcatcgatttgccggctttccagcagctccaacagtgtcgcgggctcattttcccaaatattaaaggtgagatgggggtatctctctttgatttgtgttactttttcaagcatcagagccgcgcaataaattgttgatcccacggcaagtgtgccggctacttcctccttcagctcctgtacctcaatgactgcatcttcaaacctatgcagaatctcttttgctctttttagaaaaacagctccttcatatgtaagagtcatttgttttttcttgttccggtcaaacagaacaacaccaagttcgtcctccagctgtttgagctgcctgcttaaaggcggctgcgccatgtgaagctttttggctgcggacgtgattttctgttcttgggcaatggtaatgaagtatcgaagctggcgaatgtccaaaagaaagcgcctccttaccataccttttaggtattaaatatagatttaatagatatttttcatatggatatatcaggagtatgattgaaatgaaagcagaattcaagcgtaaaggagggggcaaagtgaaactcgttgtcggaatgacaggggcaacaggggccattttcggggtcaggctgctgcagtggctgaaggccgccggagtggaaacccatctcgttgtgtctccttgggcaaacgtcacgatcaaacatgaaacaggctataccttacaagaagtagaacaactggccacatacacttactcacataaggatcaggcggcagccatttcaagcgggtcgtttgataccgatggaatgattgttgcgccgtgcagcatgaaatctctcgcaagcattcgcaccggcatggcggataatctgctgacacgtgcggcggatgtcatgctcaaggagagaaaaaaactcgtcctcttaacgagagagacgcctttgaaccagattcatctcgaaaatatgctagcgcttacgaaaatgggtaccatcattcttcctccgatgccggcattttataatcagccgagcagcttagaggaaatggttgaccatattgtatacagaacgttggaccaattcggcattcggcttcctgaagcgaagcgctggaatgggattgaaaaacaaaaaggaggagcttgatcatggcttatcaagatttcagagaatttctcgctgcccttgaaaaagaaggacagctgcttacagtgaatgaagaggtaaagccggaaccggatttaggggccgccgcacgggcagccagcaatcttggcgataaaagccctgcgctcttatttaacaacatttacggctatcataacgcgcgaattgcgatgaatgtcatcggctcttggccaaaccatgccatgatgctgggcatgccgaaagacacaccggtaaaagaacagttttttgaattcgcaaagcgttatgaccagtttccgatgccggtcaaacgtgaggaaacagcgccatttcatgaaaatgaaatcacagaagatatcaatttgttcgatatactgcctcttttcagaataaaccaaggagacggaggctactatctagacaaagcgtgtgttatttcccgtgatctagaggaccctgacaacttcggcaaacaaaatgtcggcatttacagaatgcaagtcaaaggaaaagaccgccttggcattcagcctgttccgcagcacgatattgcaatccatctgcgccaagctgaagaacgcggcatcaaccttccggtcactattgcgctcggctgtgagccggtcattacaacggcagcatcgactccgcttctctatgatcaatcagaatacgaaatggcaggtgcgattcaaggcgaaccatatcgcatcgtcaaatcaaagctgtctgatctggatgttccgtggggcgctgaagtggtgcttgaaggtgagattattgccggagagcgcgaatatgaagggccgttcggtgaattcacaggccattattccggcggacgcagcatgccgattatcaaaattaaacgcgtctatcacagaaacaatccgatctttgaacatttatacttaggcatgccttggacagaatgcgattacatgatcggcattaacacatgcgtgccgctttatcagcagttaaaagaagcgtacccgaacgaaattgtggcagtgaacgccatgtacacacacggtttaatcgcgattgtttccacaaaaacccgctatggcggatttgcgaaagcggtcggcatgcgcgcactcacaacgccgcacggactcggctactgcaaaatggtcattgtcgttgatgagaatgtcgatccattcaaccttccgcaggtcatgtgggcgctttcgaccaaaatgcatccgaaacacgatgcggtcatcattccggacttatctgtcctgccgcttgatccgggatccaatccatcaggaatcactcacaaaatgattcttgacgccactacaccggttgcgccggaaacaagaggccattattcacagccgcttgattctccgctaacaacgaaagaatgggaacaaaaactaatggacttaatgaataaataaggaaaggatgttcgaaatgcatacatgtcctcgatgcgactcaaaaaagggagaagtcatgagcaaatcgcctgtagaaggcgcatgggaagtttatcagtgccaaacatgcttttttacatggagatcctgtgaaccggaaagcattacaaatcccgaaaaatacaatccagcgtttaaaattgatccaaaggaaacagaaacagcaattgaagttccggcggtgccggaacgaaaggcttgatcggcgtgaacagtatgtcagaccgtctctttgagctgcttgacgggagatgcctgaatgagaagcagcatgaggccttcgttctgcaaacagtatcagaggatggctggccgcatgccgctatgatcagtgcgggtgaaattatcgcgctgagccgaactgatatccgaatcgctctgtggaaaaacacaatgacttcggccaacatccttcgcacaggaaaagcacagttcacggcgtggtggaagggagcggcctattatgtaaagcttgaatgcgcgcctttaccgcctttgaaagatgccgaatatgatagagaccgtttttcctgccgcatcgtttcagtgaaggaggacgttgcgaaatacgctgatttgacttcaggtgtccgtatacagcttcacagcgctgaagaggtgctgagcagatgggaaaagaccctggaagatttaaagcggtaatatcgatagcctgacgccatgcgtcaggctttttttatataatgaaaacaaagggggcgtgagaaatggaacgtgcggggatctgtcactcggacggctttgatttagcttatcgaattgagggcgagggcgcacccatccttgtgatcgggagtgcggtttactacccgcgccttttttcctcagatatcaaacagaaatatcaatgggtctttgtcgaccataggggatttgctaagcttaagcgagggcttcgtgcggaggattcgaggcttgatgccgtcttggctgatatcgaaaggatgagaacatttcttcagcttgaggatattattatcctggggcattccgggcatgcttttatggctttggaatatgccaggacatatcctgaacatgtccggaaggtggcgctcttcaatactgcgcctgataacagtgaagaaagacagcgaaaaagtgaatcatttttcatggaaacagccagccttgagagaaagaaacgctttgaaaaagatatcgcgaatttgccgcaggacattgacaaagatcctgaaagacgcttcgtgcatatgtgtattcgcgctgaagcgaaaagcttttatcaagagcggccgcatgcagctgccttatgggatggcgtattcacgaatatgccgatcattgatgaattatggggcaatacatttgcccagattgatcttattcagcggttagctgatgttcgtatgccggtgtatatcggattagggagatatgattatttggttgcacccgtttcgctatgggatgctgttgacgatttatatccccatgtggataaggttatttttgaaaagagcggccatcagccgatgctggaagaaccggaagcctttgatcaaagcttcagcaaatggctggatcaataaaaaaacagcccgcagatcaaaatccgcgggctgtttctgattataagacccctttcatcgcgcgtttgatcatcggcgagagcagcaggagaatgccgccaagaacgatagaaatcaaaccgatggtgccgaagtacattgtttcaggaattttatcaaacaatccggctacttgggcattgatcgcttgggctgctgcgttcgtcagaaaccacatactcattgtctgtgcagagaaggcagctggtgccagtttcgttgtcacggataaaccgactggagacaggcacagctctccaagtacgacaagcaggaagctgagaacgagccaaagcgggcttacgagtgcttcttttccttgcatagcagggaataccataatgataaatgacaatccggctaaaataattccgattgagaatttaactggtgtagacggctggcgtttgccaagcttcatccagagccatgcgaatattggtgcaaaaatgacgacaaacaatggatttaatgattggaaccatgatgactgaagttcgaatccgcccaatgaaagtcttattcgttcatcagcgtataccgcaagaatggtcgctccctgttcctgaatggcccagaacatgacagcaccgataaacaaaggaatgtaagcggcaagacgggatttttctgtgctgtccgcttttttgcttgtaaacatgatgatgaaataaatgacaggaatcaaaataccgagaatacttacaaggtcgataaaacgattgatcgtcagcacgcctgtttgtacagagataatcactgcgatcgccacgatgataacaccgattccggtgccaatcgcagattttttagacagcggattcggcacattggaacctgcaagcccgaggtttttctttcttgtcaaagcaaaaacgataagtccgagaagcattccgaccgcggcagctccgaagccgagatgatagttgtacttctgtccgagtgttccgacaattaacggcgcaagtaaaccaccgaggttaatccccatgtagaaaatactgaaacctgagtcgcggcgcgggtcttctttcgtgtaaagatccccaaccacgcttgaaacgtttggttttaataagcctgttccgacaataataagcaccatgctgatatagaatgcgatcgcgctgcccggataggcgagtgcaatgtggccgaacataatgaatatgccgccgtaaaacacggtgtttgcggtaccgaatacccggtcagcgagccatccgccaataatggtggacatgtatacgagtgatccgtaaatcgacataatggcaaccgcagtgcccttgtcaaagccgagccctccgtttaccgtctctgtatacaaatagtaaagtaagattgctctcattccatagtaagagaaacgctcccaaaattcggtgaaaaatagtgtaaatagtcctcgcgggtgaccaaagaaccctttttgcgggacgcttttaatgatactttcgttatcaatcgaagccatgtcagccaaaccctttctaaaaaaagtgtattataaaaatcatattcttatataatacttgtgtcaatataatttatactcatttcaaatagttccatattggaaaaattataaatacctaaaaatagtgatttcctcctaatttttaaactttttatcgtgagattttcttacacaactattcctttatatttttttaataaaattttagagaaatgtacaagcagatcgggcctttgtgagtaacatgatagtaatcatagagaaggaggctcgcaaatggctgaattcatattaaatgcagcggatttcggtgttcctggagatggtaaaacggattcgacagaacggattaatcagtgcctcagtacagctgtttcgaaaggctatcatactgtctggtttccaaagggaacatatttaatagacgcaacgcttggcggagatcttaatcagaggtttcgaaacgcggggatcattgttcccggcaaccttgagattatgatggaccccgaatgtatcatgaaagtgataccgaatagttcgtggggttattccgcattttatgtaggcaagcaagagaatataactatttccggaggacaaattatcggcgaacgggatgagcatacgtatgtctcggcggggataaggtcaacccatgaatggggctttggcatatgtattgaaggatgctcgaatgttctcattgatgatgtgaaaatttccgattttaccggcgatgggatcatagtcagcccaaggggattaaagaccaatcaagattatcgaacgtcagagcaaattatcatccgccgctgtgaggttcggcggtcgaggagaaataacatttccattaccggatgtgacatggtcacggtggaggagtgcttgattgaagatgccggaacggggaatggaacagccccgaaattcggaattgacattgaaggatatggcgaaggtgacgttgattatgaggaaccgattaatgtatcaattcgcaataaccactttgttggaaacgtttcaagttctgtgaccaattttaacgggtatggcattttaatagaaggaaatcactctgacaatacaatcagctacggatatgggacgcaaacagtgatcaagggaaatatactgaggcgccctgaagacgcggcggctgcgccaagagtcgggataaccggactcggtgtatcacaaggaaaagagaccagtgatgcagtgatcgctggcaacctcattaccggattttcaactggaattgatgtcaggggaaagagcgttcttgtgacgaacaacaaaatcagcaactttgaaaacacagggatattggtttatcagtcttccgacgtaaaggtagacggaaaccaaattcaaaacggactgtctgaaacaaggcgcagcatcggtcttcgcgcagtgctgtcagatgacatcgcttttctgaataactgtctcattcaagtcgttgacggtgtgaacgtttccggcggaaatatgatcattaaagataatctcctgagaaaattcagccggggcatttggattgctcaagggaacgcggtgattgaagggaatatactgaatcctgacgcgtttgaagcagtgccggaatcatattctgtttccgtcacaaacaatgccggcgccatcatcaaaaacaatacatttaaagagttcaaaaattaccccatttattgctccacaagtgcgaaaacctcaattatcggcaaccacttagagagatctccgcttttggtcaccatctatatcagcgccggtgtgcatgagatttttgataataccatttcagtcaacagaacagccgggaatccgattgtgatttatctcaatggctctgcaggctctatcgtctcaggaaacaccatcaataacctctccgcgggcactgcgacagctattcaaacaaccacatcaaccaattccaaaatcatcggcaaccgcatttttaaagggaccatcaacaaacacagcagtgatacaatagacggcaatatgattgtctgaaaaaagcgccccctctaggggttcttttttttcgatttatagatcacgtatatttccctcacaagtactaaaacaaaaaataaaattacaacccattccgcaaatgttgaaatcttaaagctggacatattgttataaacggcttttgttaaactgaacccttgaagcatgtccatcaacacagaaatagctaataaacaaattaatatgactccagtcacgcccaatatcttcatgcttcatcatcctccgcttttagtgtctatcgttggcggagatgttataccgcatctaaacctcatgcataatctcaattttaaaaggaagaatatgagaaaacgacaaggaatggtatttgtgtatgcctttattttctaagcgaaagaacaataccggttcaaaagacaagcagaatactgacgagaggaaccaggaacagcagcaagaaaaagaaaggccggttctcatttctccaagtttggcaaagaatatagcggaaacgaaaaaggaagtcggaagcagctctgacgtcatcattcgcgagattaaaatcggggagcaggatcatgtccacctagctgttatctatattgctgggctggtcgataataacacgatccatgagtcgttaattgacccattggtacaggatgagtctatccagaatactcatgcgatccagcaaattcttgaaaaaacgctcccgctgggcggggtgaaagcggaaaagagctgggacaagcttttttccgagttaatgctcggcaatgcgctcatttttgctgatggccatgatgaagctttgatttgcagcactcaagggggagagcagcgctccatccaagagccgagcacccaggcgtcattccgcggtccgcgccaagggtttacagagtctctgcaaaccaatatttccatgatccggcgatacattaaaaatccgaatttatgggttgaaaaaatgaaaaaaggttctgttacgaatacggatatcgctctcatgtacattcaaggaatatgcgatgaaaaggtgctgaaggaagtgaagcagcgcctggaaaaaatagatattgacagtattttggaatctggatatattgagcagctgattgaagatgaaacctttacgacgtttccgactatgtatcatacagaacgccctgatgtagtagcgggtaatctgttagaaggaagattcgcgattattgtggacggaacaccgtttgtgcttattgccccggccttatttgtccagttttttcagtctgttgaggattattattcgcgttttgacattgcgacaagcataagaattcttcgtgttttagtctttttcatttcgcttgtggctccggctgtatacgtggcagccacgacgtttcatcaagaaatgataccgactgagctgttagtggtcattgcggcccagcgggaaagtgtcccgtttccggctgttgtggaggcgctgacgatggaggttgcttttgagattctgagggaagcgggattcaggctgccccgggttgttggctcggcagtgtcaatcgtaggcgcgctcgtaatcggccaggctgccgtacaggctggtatcgtctctccggcaatggtgattatcgtggcactcaccgcgattgcgagcttcgcaacaccggcgtttgcaatggcgatttcagcccggcttattcggtttatttttcttattgcctcagctgttatgggtttttacgggctgattttagggatcattatgatgtttgtccacttatgcagtcttcgttcatacggcgttccatatatgtcgccgcttgcacccttttcttcacaaggcgtaaaggacgcgcttttccgggttccgtggtgggccgatgaaaaaaggccggaatcggtcagcaaggaagataaggtgcggcaggggcaagatcaacgcccagagccggccgcttcacgaggaatggtgaacaaagatttggaagaaggggataagaatggtacgtaaatgtctattagtcgttctcatgcttttgagcgccattgtgctgcccggctgctgggataagagggagctgacggatcttgcgattatctcggcgattggcatcgatcggacaaacgacagcaactacgtgctgcatcttcaaattatcaatccagggaatgttgccggcggccttcagggaggaggtgatggagacaggccgcctgtatctgtctattcgattgaaggtaacaatttaacggaagcactcagaaaagcctccataaaggtatcacggcggctttattttgcccataccaatctagtcgtgatcaatgaaaagctggcaaaagaagaaggtttggattttgtattagataatcttgaccgggacacagaatttaggtcaacagcaacattcgtcgttgcccataaaacaaaagcagaaaatattgtgaaaatcttgacgccaattgataaaattccatcaaataaagtcaataaaaccttggatttcacggaggcgcaatacgggcgggtggtcaaaaccaatattcaggacgttttgaaaacacttgccgccaacactatggcaccggtcatccccggatttatgatgattggtgacgataaaaaaggagtcagcatggaaaacacgcaggcgactgacccgaaagccattcttcaggcagatggtctggcggtttttgataaggcaggatatttaaagtattggctggaagatgatgaaagcgtgggggcagtctggcttatgaataagatccagcatacgttgattaatgctgactggggcaagacgaaggatgcggtcagcttgcaggttacccatcaagatacaaagctggtaccgaaaatgcggaacggacgtccgtacatccatgtgaaagtgtcggttgaaggtattattgatgctgtcaaataccctttccaattgtctgatcccaaggtgctggccgctattgaaaaagcgctcaacaaagagcttgaaaaggaaattagccatactgtgaaaaagattaagaagaataaaatagattttatcggttttggtgacacgatatatagaaagtatccggagcagtgggagaaaatgaaggacacatgggacaaagaatatttgcccgaactgcccatcgatgtgaaggccgagacgtatatcagaaggacgggattgcgaaacgatccgatcaaacaccagtttaaagatgattaggtctgaagaaaggggaagtgacagatggaaaaagccagaataagcataaggcagctgtttgtcatgattatcatttttgaactgggcagctccttattgattacatcgggatcaatggcgggcagggatgcttggatagcagttttattaggctgtgcgatcggaatgtttcttttctatttgtatcaaggcatttatcaatgttatccgaattcttctccgaaagaatatatggatgatatgctgggaaccaagctgagctggctgttttcatttctctatatattgtactttgcctatattgccgcaagggtgctgcgtgactttggagaaatgctgctgacgtttgcttatcatgatacacctatcattattgtaaatgctttattaatggtagcaagcatatatgccgtaagaaaaggaattgaagtactcgcacgcgctgccgaacttcttttcggggtcatgtatttactgggcgcgatcgggctcgtgctgattattgtctcaggcactatagacccgcacaatttaaagccggttttggcaaacggtatttctcctatccttcactctgttttcacgcagaccatgtacgtcccatttggtgaagtcgttttatttgtgatgattttccctaacctgaatgacagaaaagatgtgaaaaaaatggggatgattgccatggctattagcggattggttgtggcgctcaccgtggcgattaatatcagcgtgcttgatgttgatcttacactcagatcccagttcccgcttttaagttcgattcagacaatcaaggtcgaagaatttttagaccggctcgatgtcttttttatgctggcgctgatcatcggcggcttctttaaggttagcctctacttatatgccactgtggttgggacatctacgctctttaaggaaaagaatccctctcaattggcttatccgatgggattgggcatcttaatcctttctataacgatcgcaactaacttttcagagcacttgaacgaaggcttgaacgtggtgccgctgtatattcatttgccttttcaattattgtttccgctctttctgtttattgtggctgtttggaaaaagaaacgaagagagaagtcaaaagggacaggagcaaaaaaatgataaaaagagcggggggatgcagccgccgctctttttatgttcacttctatataaaagggggatatagggtgcgcccctgtctgcactggcagaggcgcgttttgttatacgactgcgacgttttccttcacagtaaaacttcctcttgaaagtctgatattgatgtctgacacttttgcaatttgttcatcgtgcgtcaccataatgacgcatttattttccttgtgcgccagatcttgaaagagccgtacgatctcttttgatgtgtcctcatcaaggtttccggtcggttcatcggctacgataagatccgtgtcacagcagaaagcccttgtaattgatacccgctgctgctgtccgccgctcagtgtgagcactttttgccgggcttgtttttcgttgatgccaaccttctgcagcatgtcaagcgcatatgattctttgttcttttctttagatcctgtgatttccatagcggttgtgacgttctgcaaagccgtcatatacgggagcaggttgtacgcctgaaagacgattgatacatattgatttctgaaattggttaagccgattttagaaaccgcttttccgtcgtaaaggatgtttccttcttttggtgcgtcaagtccgcctgccagagacaggaaagtggttttccccgtccctgatgtgccgacgattgtgtagaattttcctttttgaaagctgatgttaatatcctgaaacaatggctggcttttgtctttataccagtagccgacttgttgaaattctaataagctcataggttccgcctctttctattcctgttttgtcaatatcgttttcggatgaagccgcagtactgaaattgacggcagcaatgttgcaatgattgcgattaggatgccgatcccgcccagaataagcatgtcgttcatagaaaccgcgacgttcagtgaatcgataacgtccacgtttgatgaactgtggccgaacattttgccgcccatgccgccaccgccgccgggcatttgtccgcttgcggtttgcgttgaatcggttgatgaactgatttgctgggataaaagctgatttccaagctgatttgcgacgagatttcccgtcacagatgcaaggccgatagcgataacggccacaatcagaatctcagtcaagaactgtccaatcaatttccatcgtttttcaccgatggccattaacacgcccatttcgtatttgcgctctctgattgacatcatgacaatcaggccaagaatgacggcgcctgccactgatacaagatacaccacgtttttagagaaagaagccacattttcaatcggtccgaccatttgctggtaaagctgatcgtttgtattcagtgtgtacgtatcgaagtctattgatgttttcttcgctgcttttacgaaagcatccatatttttcgcgtcgtccatatagtaaacagctgagtcaatcgtatttttatagtcgtcgcctttcagcgccgctgttgctgtgtaaggcgtataaagcttgttataagggtttaagaaagagaaattttgggcttggtcatcgcctgaagatgttgttttataaataccgacgatcttcagctttaccgtcgtatcttcatctgttgctgattcaattgtgatcgaatcgccaacgctcaaatcattttcttccgctaaagtttcgttgatcactgttacttttttgccgacatctgattttgtaatcgcgcgtccgtctgtgatttttgaatctccgtcagagaaatcatcgactaacgctgtgctgatgacaccttcaatagaaagatcggcttgaaccatttgcggtccgccttgtcctccgccttgactgtttttagcggttgagcttgaactgcttgagctggaatcacttgaactagagcttgagctttcaatcgcatcaaagtttcccgcgttggctgaagctgatgtggtgtaattgtagctcttcacatggtcaagcgctgcaagcttattcgcatcagacactttgatcggtgtggaatcgaagctgcgcttttcaccgctgtcctgctgtttttccatttgcttttggcggtcaacctgaagtgtcacgcttccgccgagttcctgtctggccagttcgcttgatttttgtgctgccgactggatggtgaggcctgatagaacaaagacacatatgactgtaaacacaaataattgcaataatgtttttccctttttagccttcatattccaaaaggcccgtttgataaagttcatttatgttcctccgtataggtactttgattgataaggccgcctctggggcgggcttgcttgttgataaattaatagtagtccaaaggtatgaaaaaaatatgaacaatctatttctagttgatgaaataaaaactaacaattgtgaaacgcaaaaccttctgtttaaaatggtgctattatataaaaaagcatcaaaacaaccggaggatataatgaaaatattaatgatagaagataatgttagtgtatgtacgatgacggagatgttcttttttaaagaaggttttgaagcggaattcgttcatgacgggttagaagggtaccagcgttttacggaagaaaattgggatctgatcattttggatatcatgcttccatctatggacggcgtgaccatctgcagaaaaataagagagacaagcacggtgccgattatcatgctgactgccaaagacactgaatcagatcaggtcatcgggtttgagatgggggcggacgattatgtcacaaagccgttcagcccgctgacattggttgcccgcatcaaagccgtcatcagaagatataaggcgacaggcaaagcggttattgatgaagatatgatcgaaacggaatgctttaccattaataagaagacgagagaagtattattaaacggagagcctgtagaaaatctcacgccgaaggaattcgatctgctttattaccttgtccaaaatccgcggcaggtgttctcaagagaacagctgcttgagcaggtatggggctatcaattttatggagatgagcgaacagttgacgttcatatcaaacggctgcggaaaaagcttgccagcgaagacaagcctttcttgtatactgtgtggggagtagggtataaatttgatgaagattaaatatttatatcagctgctgctaagccacatcagcattttgattttagcgtttgtcattatcatttctctgttttcccactttgtgaaagaatttgcctatcaaaacaaagtagaggaattgacgtcatatgcggtgcagatcgcaaatgaattccaagccggccaggtggacatgcgcaggctctatccttatcaggacattttaagcacaagaaagacgcagtttatcatctttaatgaagagcaacagccttatttccttcctgaaggctttcatcacccaccaagggaacagctgaagaaatcagaatggaataagctgaaaaaagggcagactgtcatgatcagggcagatggccgttttgatgatgaagtgtcccttgtggcgcagcctatatttgttcagaacgaatttaaaggcgccgttctgctgatttctccgatcagcggtgttgaacagatggtcaatcaggtcaacctctatatgttttacgctgtgatcagcacgcttgtgattacgattcttgtgagctggcttctgtccaaattccatgtcaagcggattcaaaagctgagagaagcgacagataaagtggcttccggcgattatgacatccatttggaaaacagctacagggacgaaatcggcgtactggcgtctgactttaatatcatggcgaaaaaactaaagcagtcaagggatgaaatcaatcgccttgagaagcggagaaggcagtttatcgctgacgtgtcacatgaattaaaaacaccgctgacgacgatcaacggtttggttgaagggctgaacagccatacgattcctgaggataaaaaggataaatgcttctcgctgatcagtgaggaaacgaagcgcatgctgcggctcgtaaaagaaaatctggattatgaaaaaatcagatcccagcaaattaccttgaacaagctagacgttcctctgatcgaggtgtttgaaatcgtgaaagagcacttgcagcagcaggcggaagaaaaacaaaacaagctgatgatccaagtagaggatcacgtcatcgtacatgccgattatgaccggttcattcaaattctcgtcaacattacgaaaaacagcatccaatttacgcaaaacggtgacatttggctgcgcggaatggaaggttataaagagacgattattgaaattgaagacacgggtatcggcattccaaaagaggatattgagcatatttgggagcgattctataaagcagatatttcaagaacgaacacagcatacggtgaatacggactcggtctctcgatcgtcaggcagctcgttgaaatgcaccagggcacagtagaaatcaagagtgaagaagggaaaggcacaaagttcatcatccgccttcctttaacggcaaaacagcaatagcatacagggcggcgcatcaactgatgcatccgccttttttgcacaccgcttcggtttattgcgtgctcccgaaaacaaagattgcgtgtttttcgggttgggacggtctataaacatgataaaatatgacataaacagtttttgatgggagagggtgaaggaatgaagagcggggtaattccttcttcagcggtcggtcaaaaaattaacgagtggtacagatatatccggacattcagcgtgccggatgccgaagtgttaaaagctgaaatccagcaggaactgaaacacatgcagcatgattccaacttgctgctttattattcactaatggaattccggcaccagcttatgctggattatcttgagccgttagagaaattaaatatcgaagaccagccaagcctgtctgaattatcaagaaacattgacagcaaccaggcagatctcaaagggctgctcgactattacgtgaatttttttcgcgggatgtatgaatttgataagcgggaatttatttctgccattacatactataaacaggcggagaaaaagctctcctttgtcgcagaccatattgaacgggctgaattttattttaaaatcgcggaagcttattattatatgaagcaaacgtatttttcattgattaatataaaaaacgcctatgaaatttacgtggagcaggaaacctataatgtgagaatcattcaatgccatttcgtgttcggggtcaacctgatggatgaaagaaatttcgaacaagccgcacgccatttcaaattggcgctcaacatggcccaagcagaacaaaaagcccagctggttggaagagcatactacaatctcgggttatgctattacaatcaagaccttctagaccctgccattgattactttgaaaaagcggtctccacatttgaaagcagcaggatcgtcaattctctcccgcaagcctattttttaatcaccctgatttattataaacagggaaaacatgataaagcttcggaatatcacaagcggggctatgaatatgctaaagaaacagacgatgcagactatgccgtaaaattcgagtttttacaatccctatatcaggatcagcccaatgaagaaggaatcgaacgatgtttccaatacttaaaaaataaaaatatgtacgctgatatagaggatttagccctagaagtagcaaaatattactatgaacagaaatggtttaaactgtctgcttcctactttctacaagttgaagaggcaagaaaacaaatacaaaggagtgaaggtttgtatgaaattgaaatctaagttgtttgttatttgtttggccgcagccgcgatttttacagcggctggcgtttctgctaatgcggaagcactcgactttcatgtgacagaaagaggaatgacgtaagaacaagccccttctcattagcgagaaggggtttttcttttcaaaaaaacaccgcaggacatagtcttgcggtgccgccttcatggagattacgtttatttagtagcctcctacaaatgcagttcccacaatgatcaagaggataaataacacaacaatcaaagcgaaagaagttccataacctgacattttgtgcacctccttgcgagattgcttcagcatatactgcaaaactgtggcggacagggttccgcagagacggtcagcagcttagtagccgccaacaaacgcagcccctacgataattaaaagaataaacaatacaacgattaaagcgaaagaactgatgccgccgtaaccgccgccgttagagtatcctgacataaggtttcacctccctatgaaggatactataagatatgctgaaccgatccatttggcagggataatagtggacaagagaaaaaatgaagaattcggctatatgaaggtgatataaaaaatagcgggcgctgccgcccgctatttatgtacgattaagagatcagcacgcccgcgaaaaattcctggtataacgcttggacggcttttctttcttcggcttcttttacgccaaacatcatgctcacttcagaagatccctgattgatcatttcgatattcacctgtgcctctgataatgctttggcggctcttgccgttgtaccgacattgtggcgcatcgcttcccctacaaccataatcagggcgagatgatgctcgacgatgacttcatcggcatgcaaatcctcttcgatccgtttgatgacgctgcgttcagtggcggcatccatttgcccctgccgtaaaatgattgtcatgtcatcgattcccgatggaacatgctcatacgtcaaaccatgctcctccaggatgtgaagggctctgcggccaaaaccgatttctctgttcatgagatacttgctgatataaatgctgcaaaaaccggtgtcgctggcaatgccgacgacaggcccgtttgtgttatcccgcttgctgacgacgcgggtgccttcggctgaggggttgttcgtatttttgatctgaacaggaatccccgctctgaatgccggaatgagcgcttcatcatgaaacactgaaaaacccgcgtaggacagctcccgcatctctctatatgtcagctcgctgatttcctttggattctcaacgaaggacggattgacagaatacacagcgtctacgtctgtaaagttttcgtacaaatcggcttgtagtccgttggcaagaatcgaaccggtaatatcagaaccgctccgtgagaatgtgatcacatcgccatccttgctgaatccgaaaaaaccgggaaaaatgatgagtccgtcacgttcccgaagacgatagaggttttgataggattcaggaagaacttgcgcgttgccgggttcatttgtcacaaagaggccagcatccttcgggtttacatattccgctttgacgcctttataacggaagtaagcggcgatcagcttggcattgttatcctctccgctggccttgactgcgtcaaggtattgctcgggattgcttttatctccttctaaaagcgtaaacagatcatttctgattttttcgataatgctttgccctagctgaagctcattggcgatgagagcgtaccgttccacaactgcttccgccagttcaggtgcactgcctgttgccaaatattgttctgcacatgcgattaagagatcagtcactttcgtatcctcggcatagcgttttcccggagctgaaacgactacagctttccgtgccggatctgaggtaacgatgtgaaacaccttgtcaagctgggcgcctgaagcaagtgagcttcctccgaatttaacgaccttcatgtttacatctcctaatgtttaaaattttcacacaaatttagtatttattatctctctttcagtactgtaaatcaagggggaatttctatatggggagaacatttgtattttccacgaggaataatgtcaggtttgctgaccgtatacctgcgttataaagataaatatggtaaacagcctaacgttttgggatggaaaatggttagaatgattagtaaaatggataaatgactaggttaatatttttaaagaatattgactaaccctagaaaaatggtaatatgtaaatgataatgataatcaattactatatggccatattgttttgagtccttgcggagtaggagatacgttctttttgctgtaaggatgtaaggaggcagcatgaagctacgttacttatttattctacttatcatattagcagtcacatctgtatttatcggtgtagaagatctgtcgccgcttgatctcttcgatttaagcaaacaagaggcgtcaacgctgtttgcaagccgtttgccgcgattgatcagcattgtcatcgcgggattaagcatgagcatctgcggtttgattatgcagcagatcagcagaaataaattcgtgtcaccgacaacggcgggcacgatggattgggctcggctcggcattttaatttccttgctgctgtttacatcggccagtcctttaatcaaaatgctgatcgcgtttgtctttgcccttgcaggaaattttctgtttatgaaaatccttgaaagaatcaagtttaacgacaccatctttattccgcttgtcggtttaatgctcgggaatatcgtcagttcaatcgcgacatttatcgcatataaatatgacttgatccagaatgtgtcatcatggctgcagggagacttctctttagtcgtgaaaggaagatacgagcttctttatctgagtattccgctcgtcatcattgcctatgtgtatgcggataaattcacattggccggtatgggtgaaagcttttctgtcaacctcggcctgaagtacaaacgggttgtgaacatcgggctcattatcgtgtccctgatcacgtcccttgtcattttgactgtcggtatgctgccgtttctcggtttaatcatcccgaatattgtatcgatttacagaggagacaatctgaagagcagcctgccgcatactgcgctgttgggagcggtgtttgtgctgttttgcgatatactgggcagaatcattatcttcccttatgaaatctcgattggcctgatggtcggaatcatcggcagcggcattttcctgtttatgctgttaaggagaaaagcctatgcgtaaccagatgaaaatagctttgctcgttggtttagccattgtatgtataggcttgtttttgttttatgacttaggcaattgggattacaccctgccgagacgaatcaaaaaagtcgctgccattgtgctgacggggggagcgattgcgttttcgaccatgatctttcaaacgattacgaacaaccgcatcctgacgccgagcattttgggccttgattctctctacatgctgattcagactggcattatctttttgttcggttctgcgaatatggtcatcatgaataaaaacatcaactttatcatctctgttctgctgatgatactgttttctcttgttttgtatcagatcatgttcaagggtgaggggagaaatatctttttccttctgcttatcggaatcgtgtttggcacgctgttcagcagcctgtcttcttttatgcagatgctgattgatccgaacgagttccaagttgtgcaggacaagatgtttgccagctttaacaatatcaatacggatttgttatggctcgcgttcatcatcttcctgctgacaggcgtttatgtctggcgttttacaaaatttttcgatgtgctgtcgctcggacgcgagcacgccgtgaatttgggcattgactacgacaaagtggtgaagcagatgctgatcgtggttgcgattttggtttctgtttcaacagcgctagtcgggccgattatgtttttaggccttctggtcgtcaacctggcgagagaattcctgaaaacatataagcattcatacttaatcgcaggctccgttttcatcagcatcattgcgctggtcggagggcagtttgtggttgagaaagtgtttaccttctcaacgacgctgagcgtcattattaattttgccggcgggatttattttatctacttgctgttaaaggagaataaatcatggtagaggtcagaaatgtaagcaaacaatatggcgggaaagttgttcttgaagagacgtcagtcacgattcaaaagggcaaaatcacctcgtttatcggtcctaacggcgccggcaaaagtacgctgctgtctatcatgagccgcctgatcaaaaaggattccggcgagatttacatagacggacaagagattggagcatgtgacagcaaagagcttgccaagaaaatgagcattttgaagcaggcgaaccaaatcaatatcaggctcacgatcaaagacctcgtcagttttggcaggtttccgtactcacagggccggctgacagaggaagactgggttcatatcaaccaggcgctcagctatatgaagctggaagacattcaagacaaatacttggatcagctgagcggcggacagtgccaaagggcatttatcgccatggtcattgcccaggacacagattatatctttctggatgaaccgctgaacaatctggatatgaaacactcagttgaaattatgaaactgctgaaacggctggtagaggagcttggaaaaacgatcgtgatcgtcattcacgatatcaattttgcttcagtctattctgactatatcgtcgctttgaaaaacggccgaattgttaaagaaggactgcctgaagaaatgatagaaacatcagtgcttgaggaaatctacgatatgaccatcccgattcagacgattgataatcaaagaataggtgtctatttttcttaatatatagaagaggtgaagagcatgaaaaagttcgcattactattcatcgctttggtgacggcagttgtgatttctgcatgcggaaaccaaagcacaagcagcaaaggttctgattctaaggaagaacaaatcacggtgaaacaccagctggacaaaaacggaacaaaagtaccgaagagccctaaaaaagttgtcgtatttgactttggaagcttagatacactagataaacttggtcttgatgataaagtagcgggactgccgaaacaagcccttcctaaatatctgtccaaattcaaggatgacaaatatgctgacgtcggaagcttaaaagagccagacttcgagaaagtggcagatttagaccctgacttgatcattatctcaggaagacaatctgagtcttacaaagaattctctaaaattgcgccgacaatttaccttggcgtagacacagcgaagtatatggaatcatttaagtctgacgcagaaacaatcggtaagatcttcgataaagaagatgaagtgaaggatgaactcgcaaaaatcgatcattcaatcgcagatgtaaagaaaacggctgaaaagcttaacaaaaacggtctcgtcatcatggcgaacgacgggaagatcagcgcattcggtcctaaatcaagatacggcctgatccatgacgtgttcggcgtgacaccggctgataaaaacatcaaagcgtctactcacggacaaagcgtttcttacgagtacatttcaaaaacaaacccggattacctgtttgtcattgaccgcggtacagcgatcggtgaaacatcatctactaaacaagtcgttgaaaatgattatgtgaaaaatgtaaacgcagtgaaaaatgatcatgtcgtctaccttgattctgctacttggtacttatcaggaggcggtcttgagtctatggcacaaatgatcaaagaagtgaaagacggtttagaaaagtaaaaccaaaaagagcctccgctaagtagcggggctctttttttgttaatcagcgtgccggctgctgttcggcagggcgctgaggtttctttaatgtgattgagagaaggaagccgacaagtgcaatgacggcagccacaataaaagcggcattcatgccgtgcagggcggcgtgctttacatttgtcgtgcctgcatgtgccgcctggttgctcatcacggaaaccaatagtgcggttccgatcgagccgccgacttggcgaatcgtgttgttcatcgcagttccgtgcggaatcaagtggcgcggcagcgcgttgattccggctgttgtcaccggcatcatgatcatggcggtgcctaagagacgaacggtgtataaaacgacaatccaagcgagtgacgtatggtcagtcagctgcataaacggcagagatgtcaggaagatgatgcagaaaccggcaatcgccagccatcttccgccgacacggtcaaaaattctgccgataatcggcgacataaagcccatcacaacggctcccggaaggagcataagccctgtatcaaaagctgtgacgtctctgacattttgtgtataaagcggcaggatggtttccgtaccgatcaataatgcaaagacgagggttcccagcagtgttgttaagctgaaaacgccaaacgtgaagacgcggaattccagcatcggtttttcaagcttcatttgtcttgtgataaacaagagcagcgcgatgacacccaccagcagtgaaatcaagacggttgaactggaccagccgtaagagccgacgcttgagaagccgtacagaaggccgccgaacccaaatgttgaaaggatgactgataaaatatcaatctgtgtttttcttaaagtcgtcacgtttttcatcaggatgctggcaagaatcaaatcaatcacagcaaacggaagaataatataaaacaatgatctccaagagaaagcttcgacagcccatccggaaagagtcggtccgatcgcaggcgcgaatgagatgaccaatccgaccatacccatagcctggccgcgcttttcaatcggaaagattgtcaggaatacagtctgcatgagcggcatcataatgccggctccagccgcttgaatgatacgcgctgtcagcagaaccgggaagttcggcgcgaacgctccgacgactgttccggcagtgaaaatgctcattgctgtgatgagcagcgcccggcttgtgaatttctcaattaaaaacgcggtaatcggaattaaaatcccgttggttaacataaatgatgtggtcagccattgtgcttggttggcatcgacattgaaatccctcatgatatggggaagtgcggtaatcaacaatgtctggttcaaaatcgccacaaacgctccggctaacaaaatgccgacaatgacagaacggttaaaaggtttttgttcaatacttgtgttcaatacatatcccttcttttctctaagtaattaacagtgtttttaacatggaaacgggctgtgttaaaacaccggtttgttccagatagccaatcagtgatttgagtaaaaaagcgcggggttcttccttcttcgcttcttcctccagcatagcggctgcggatgtcagttcatctacgtcatagtccgcggcggacagggaagagatgcctttatgtaattccttcaggctttccgataataggactgatttatcctttggcttgtaggaggatgctgaatgaatataaagctcgatggcttcgggcggaagaagagactggcgggtttccctgtttttgataatctgattgagggtgctgatgataaactctgcgatcgggtcaagctcaagcggtttttcctcgattttgatcagcattaaaaactcacgcatcataccgtgaagaatgatgaccaaatcccacacaaacgggagaatggtttctccatacgcctggatcagcgaatcgcggtgccagcagataatcgtcgatctggtctgatggatatgctgtttgacccggtcattgtgcagcttggggtttccgtaggtcagcatattgaaaaactgctgattccgcctgaagccctccagttccattttgaccttttgcgtcaaacgctcctccggtgtaagtgcggtattttcctgaagtcttgaggccgcggccaccatttgcttctggttaaatgacagcagctccaaaagcagatcttctttagattggaacagcttatatatcgaagcttttgacatcttacattcttctgcgatcgcctgcatggaaaccgacgtaaaatccttttccgaaaaaagctttcgcgcggctaacaagatatctgtttttttatcaagcatctcatggcttccttctttcttgaacattagaaaacccattggttcacagaaaaccaatgagtaactatgaaaaaattttaccaaataaacaaaatagaagtcaatggattttaaccgggtaaatgaaaggcctgccggaaaatccgacaggccgaataagagcttatttttcaactttaaatccttgtttttcaagcatttcacggatgtgcggatagtacaggcgctcatagtaggaagcgatgctctgtgaccaatttcttgtttcttttccgtttgtccgtttattcatgtattcagacatctgttcgtcgtatgcctgaatgtgagacgtcagctcatcctgattcaaataagtttcctgatgattgacagcttcctgcggcaagcgcggttttttcgctgaacggtcggcaggatgcccaatgacaaggccggataaagggaacacgtattttggaagctcaagcagttcgatcagctcttgagggtttccgcgaaccgcaccgatcggaactgtgccaagtccgagtgactcggccgctgctgttgctgtgccgagggcaataccagcgtctactgcgccgacaagaacagattccaatccatttgtgatttccattttgaaatcatgcagatcttcaagcgcaattttggcccggttgaaatctgcgcagaacagcaggaaaacaggagcttgatcgatccatggctggccgcctgccagctcggagattttctttttgcgctctttatcctggactgtgatcacagtcacttgctgtccgttgatagaagaaggggctgattgcaccgcttcaatgatttggtccaattgctcctgagctacaggctcatctgtgtagctgcgaatcgagcggtggtctgttaaagatttaatcacttcattcattatgagacacccttcctttactcgctaagctctgtgcggacaacatcaagaggagcgctcagcagttcttttccttttgcgacaaacccttggaaatgcgcagtttcgttatggaatttcattgccgcttcatctttccatttttcaagcatgacaaatgtattttcttcgcctactttttcaaataggtcgtattgcgcgttgccttcctcagctcttgaatgctgaacaagtgattgagcctcgctcaaaaattcctcgcgtttttctggttttactttgatgtaagcttgtaatacgatcatttaaatctcctccgttgttatgcgaatttattgttcgaatttcatcgaactaaatgtaacatgtattctaattgaggtaaaggaaaaacccttaaatagtaaaattgtcattctaattgttgtgtgatacatttgtgtcatgaacattccaaaccatccagaaacagaaacattgcagctgacaaaggttcttcatgcacttagtgatccgcttcgtttagagctcgtcaagcaattagctgaagcaaaagaaaaaacgtgcagcacctgtgcagatgtgcaggttgccaaatcgactttatcgcatcattttaaagttttgagagaatcaggcatcgctcaagttcggatagaaggaaagcgccggtattattcgcttcgcgctgaagaccttgaaaaggcatttccgggcctgcttgaagccgtgctgaatgtagaccaggaccgctggtgaatcaatcccctgtaacggggatttttttatgtccgtaaaccgctttgaaaagccgctgcacaccctcctgaatatcttcttccttcagccgtgcaaagccgataatgagagctggcctgcccgtttgccgcttgttttccttcaagttaaatcggctcattccgaatatttcaagctgcagcccggcagaatgtgacaggatgtcttgttcggtgcgcctggtatcaaattcggtaacaaaatgcagccccgcatttgccccttttacggtaacctctccgctgaactctgcttctaaagcggtgatcaggcgttctctcttttctttataatgctgcttcattttttttatatgcttctgatattcaccagactcgataaattcctgcagggtgagctgtgtgagtgatgagcaagtctgcagatcatagccccgctgtttgtatgccctcaacagctcaggcggcaacaccatatagctgatccgcaagccggggagaagggactttgaaaaggttcccatatagatgacattttgaaaacggtcgaggctttgcagcgccggaatactgtctacatcatatgtgaattcactatcataatcgtcctcaatgatatatcggcgcggctcctcggctgcccagttcagcagctgaattcttctggatacaggcataatcgttccggacggaaactgatgcgacggggtggtcaccagcacatctggctgctgtctggtgatttcagcaatcgacatgcccttttcatccagcatgatcgtctttacttgttttccggcattcttcaaaagctgatacatgcgcctgtagccaggctcctccatcgcatacacggcttccttgggtaaaagctcagtcaacagctgcatgagcacctgtgtgcctgcccctatgatcatttgttccggcctgcattttacacccctcgtcagggaaatgagcctcgtaatggccgctctcacttcatatattccttgcggatgtgacatatcgccgagcgtgcggtatgagcgggaggccgctttttgctcgcagcggaaccagcttttgatcggaaaatggtctgtatcggaactcatgtgtgaaaacgatatccaatcactctggtcgatgtgaatctcttttaggtcatccggcagtgcaaatggagggtgctcctcggcggaaaacatgtctagttcctccacgaagaaaccctttcgttcaatggtgtacaaatacccctcagccagcagctgctgataggctgaattcactgaatttacgctgaccttgagattttcagccagctcccgcttggagggaaccttcgagtgcggcagcagattgcggctgaggatttcttttttcagcttttgataaatttgctgatagatataatcggcttgttctgaacgatcgagtgtaatcgtgatatccatttgtattttctccttctgataccatcaaaaagttataattggtacttttcatcataccaaagagaagtcagaatgataagaaaataccgacagggggatattcacatgagtcaaacaacagcaagcatcacaactgcacaatggcagcaaaaacgggatcaatttgtgtcaaaaggtgtgagcaacggcaaccgcagtctggcggtcaaaggagaaggggccgagctgtacgatctggacggccggagatttattgattttgcaggcgccatcggcacgttaaatgtcggacattcgcatccgaaggtggttgaggctgtgaagcggcaggcggaggagctgattcatcctggttttaatgtcatgatgtacccgacttatatcgagttagccgaaaaactgtgcggcatcgcgccgggcagccatgagaaaaaagcgatttttcttaactcaggggcagaagcggtcgaaaacgctgtgaaaatcgccagaaagtatacaaagcgccaaggcgttgtctcgtttacacgcgggtttcacgggcgcacgaatatgacgatgagcatgacaagcaaggtaaaaccttataaattcggtttcgggccttttgcgccagaggtttatcaagcgccgttcccttattattatcagaagccggccggcatgagtgatgaaagctatgacgatatggtcattcaagcattcaatgatttctttatcgcttcagtggcgcctgaaacggtggcgtgtgtcgtgatggagccggtgcagggagaaggcgggtttattattccttcgaaacggttcgtacagcacgtcgcttcattctgcaaagaacacggcattgtttttgttgctgatgaaatccaaaccggctttgccagaactggcacttatttcgcaattgagcactttgatgtagtgcccgatctgatcacggtttctaaatcgcttgcggcaggcctgccattaagcggtgtgatcgggcgtgcggaaatgcttgatgcggcagcgccaggggagctgggcggcacgtatgccggcagcccgctcggctgcgcggcggctttggcagtcttggatattatcgaagaagaaggactgaatgagcgatctgaagaaattggcaaaatcattgaagacaaggcgtatgagtggaaacaagaattcccgttcatcggtgacatccgcagactcggggcgatggccgcaatcgaaatcgtcaaggatccagacacgcgtgagcctgataaagcaaaagcagcagcgatcgcggcctatgcgaatcaaaacggattacttttgctgacagcgggaattaacggtaatatcatccgctttttgacaccgctcgtcatctcagacagccttttaaatgaagggctcagcatcttggaggctggcctgcgagcttaatcattggaaagaaaacggctgggtctgctatcattttaagtaatcatgaaaagaaaggaatgttcaatatgccagatcaattaacggtctacaacccggctacgggcgaggagatcaaaacgattcctcagcaatcagccacagaggtagaagaagccattgaacgttcacatcaagcgtttaaaacgtggtctaaaacatcagcgaacgaaagagcgtctcttttgaaaaaatggtatgagctgattgttgaacataaagaagagcttgcagatttaattacgaaggaaaacggaaaaccctatcaggaagcagtcggcgaggtactatacggcgcaggctatatcgaatggttcgcagaggaagcgaagcgtgtgtacggaagaacggtcccggccccgacaactggtaaacgaattgttgtcacacgccagccggtcggccccgttgctgctatcacgccctggaatttcccgaatgcgatgattacacgcaaagcggcgcctgctcttgccgccggctgtacatttatcatcaagccggcgccggacacaccgctgtctgcttatgaactggcgcgcctagcatatgaagcgggcattccgaaggatgttcttcaggttgtgatcggcgatggagaagaaatcggaaatgtgttcacaagcagtccgaaaatccgcaaaatcacgttcacaggctcaacacctgtagggaaaatccttatgaaaaacagcgcggacaccgtaaagcacgtctcaatggagctcggcggacacgccccgctgatcgtagatgaagatgcggacattgaccttgccgttgaacaggcgatggcgtccaaataccgaaacgccggccaaacctgcgtatgtgccaaccgcctgatcgttcatgaatccattaaagatgaatttgctgcgaaactgagcgagcaagtgtctaagctgaaagtcggaaatggacttgaggaaggcgtcaatgtcggcccgatcattaacaaacgaggcttcgaaaaaatcgtcagccaaattgatgatgcggttgaaaaaggcgcgaaagtgattgctgggggcacatatgaccgaaacgatgacaaagggtgctactttgtgaatccgacagtgctcaccgatgtcgatacgtccatgaacatcatgcatgaggaaacattcggtccggtcgccccgatcgtcacgttttctgatattgatgaagcgattcagcttgccaacgatacaccgtatggcttggctgcttacttcttcacagaaaactaccgccgcggcatctatatttccgagaatctagagtatggcattatcggctggaatgacggcggaccgtcagcggttcaagcgccattcggcggaatgaaagaaagcggcattggccgtgaaggcggttcagaaggtatcgagccgtaccttgaaacaaaatatttgtccatcggtttataaagaatgcacgctcctgagagctgccggattttccggcagctctttttgtgttccggcgaataatcacaacaattccagccaaaataacagcaaatacattttgaaagaaggttccccaacaatggatttattattggctcttctcccggctttgttttgggggagcattgttctcttcaatgtgaaattaggcggcgggccgtacagccagacactgggaacgacgatcggggcactcattgtttctatcgttatttacttttttgttcagcccgttctgtcccttcgcatttttattgttggaatcgtatccggcttattttggtcacttggacaggccaaccagctgaaaagcattcaattgatgggcgtgtcgaaaacaatgccgatttccacaggaatgcagctcgtttccacctcattgttcggtgtgatcgtgttccgcgaatggtcaacaccgattgcgattacgcttggcgttctcgctttgatctttatcattgtgggaatcattctcacgtccttggaagataagaatgataaaaaagagggcgagccaagcaatttgaaaaagggcattttgattctccttgtttcgactcttggttatttggtttatgtagtcgtggctagattattcaatgtgtccggctggtccgcgctgctgccacaggcaattggcatggtggtcggggggttagttttaacctatagacacaaaccctttaacaagtatgcgatcagaaatattctcccagggttaatctgggcaggcggaaatatgtttttgtttatttctcagccgcgagtcggcgttgcaacgagcttttccctttcacaaatgggaattgtcatttctacgctcggcggtattttcatcctgcgtgaaaagaaaacgaaacgtcagctaatagcaattgcgatcgggattatcctgattattgccgccgccgtattcttaggaatcgccaaaacaaattcataacaaatggaggaagatgtatatgtatccggacttaaaaggaaaagtcgtcgctattacaggagctgcttcagggctcggaaaggcaatggccattcgcttcggcaaggagcaggcaaaagtggttatcaactattatagtaataaacaagatccgaacgaggtaaaagaagaggtcatcaaggcgggcggtgaagctgttgtcgtccaaggagatgtcacgaaagaggaagatgtaaaaaatatcgtgcaaacggcaattaaagagttcggcacactcgatattatgattaataatgccggtcttgaaaatcctgtgccatctcacgaaatgccgcttaaggattgggataaagtcatcggcacaaacttaacaggtgcctttttaggaagccgtgaagcgattaaatatttcgtagaaaacgatatcaagggaaatgtcatcaacatgtccagtgtgcacgaagtgattccttggccgttatttgttcactacgcggcaagtaaaggcgggataaagctgatgacagaaacattggcgttggaatacgcgccgaagggcattcgcgtgaacaatatcgggccaggtgcgatcaatacgccaatcaatgctgaaaaatttgctgaccctaaacagaaagcagatgtagaaagcatgattccgatggggtatatcggcgaaccggaggagatcgccgcagtggcagcctggcttgcttcgaaggaagccagctacgtcacaggcatcacgttattcgcggacggcggcatgacacaatatccttcattccaggcaggacgcggttaaataaaaaagcgacccagacatgacatctggatcgctttttttattatgcacgctttttcttaacaagcgctgctacagataaaataatggcagccgcagacagcacaatcgctgtaatgtctagagctgaagaacctgggttttcggaatcgtcttttgttttcgtggcgccgtgctcatctgtcacttgttttgcagacgtgatgtttgtaatggaatgaggtgtatcggcatcctcgtcacctgtccactcaacaatgctgccgtctttgtaatattggtatgcgtcccaagcagcttcctccgctttgtcagggtttttggcaacaaaggtaaactgctggaactggccttcctgaatgcctccgtcagtcgcctcccatgtcacggatactgatttgtcatcatgtttttgagtggaaaccttccagcccggaattggctcatattgctggaattcaacatccttcggcattttgaggactaccttcgttgtcggcagatttttctctgaaggaaccttcattgtatacgtttcccaagagccagcagcagactgagccggttttacagaaacatgcgcgctggcaggggccgtaaagaataagagggagccgacaatagccggacatagtgtcaatgcgatttttttcaacaacgtaaacactccttaattggattttgtaaacatgatattgatttcgttaaagtcgccggtcaggccgtggactttgatcttccagtttcctttttcattaatcgacaggttttgatcttggaagacgccttttgttttttcttttaatgtaaaggtgcttttgttttcgctgcctgacaggcctgttttataaacggttaacgtgatttgctggatatttttcacgggatctccgttatggtcggtgacccgcagctcaaaaacattttttccgggctggtttgggctgatgctgagagaaacgctttgtccgttttcaatcgctttggtttggtagaacggttccggcgccggctcaggcgggcttggcaggcttgtaaacacggccgctgtgatcaatacagcgatgccgattgcccactctgctttcaacgttcggctgattcctgtgcggcgctgctttctggtaagcagaaaatgaatcgcacctaagaccagcatgaaaacaaacagcccgcttttcactaaaagagcttggccgtacgctgtatggaacagtgaatccattgaacgaatgatgaaaaatccattgagcaagcctgaaaacaaaatgacgccgactgcagtgagcgcccatggggagaaccgtctgaccgtctcccacgcgagcgttttgtcaggctgcctccattcttttgagagcagcaaaacgagtgccgctattccgccaacccagatggaagcggaagttaaatgaaggaaatccatcaaaatgccgaccgttttttcttcaacgacagcagcatgcccggtaaacgccttggcgagcaggagaccgaaaaagaaaatgagcggcgctgtccaatagccaaaggatgaaaagcggtttttccgtatcgcagggatgacagacagtgcgagcagcacgaacagcgcggcctgtatgatccaaatggagccgcctgctgtctcaaacagtgtttctctgatgtagcccggctggaatgcgctgccccagccgccgcctgcgttcgcttttgtctgaatcggaagctgaagcaaaagcgccagccccaatgctgcgatcgagccggtcaggatacgtctcgtccgtttgacgagctgttctgatttccctttataccagaaaagatggaagaaaaccgttccgataaacagagataaggctgtatacagaatcgcgcgatctgctgctgttcccggattcagcgctgaatcggctgctttttggctgctgaatccgccatccgctttcccgatactgaacggaatgacgccggaaacaggatgtccatccgcggatacggcattccattccgctctgtacacatctttaggcagattcttcttcagcttcactgtcatgatgtgatgattatcttttttgatttcagtcttgtccgtatccacacggtcgccgtttgaattatagactttaatgtaatgaaacccttcttcaaccggttcattaaattcgatttccacctgcgcaggggcgctttttaattcgctgttttccccaggtgaagatttgacaatataggcgtgagcaaagcttgttttcggcaggaaaacaagaaaaagcagaaggatgatccaccatctgtttcgcttcatcactcagacaccaccttccgctgtatgtgttgtgttatttcttggtgcaggtgcagcgtttctttcggtcttgaagcatgtcttccagcgcttggtcgaaagtgcggacggctccgccgaatcctttttgaaatcgttcggcatggtcaagtgtcgcaaacggaatggcctgcggctggcagcagtgcaggtttaattcagcatttacgacgaaataagccgaaccggcactgacggttgtctgtaacagaaaatctctgcaaatcaagtgtgaaacctcttccgttttatccgcgtaacgcaaaaacgcgcaatgtgcgcagcatagctgttcaatgtcttggtttaccgtaatcagctgaaccgaatgagcttgattgacgggcttcaagcaatagctgcacatatgatctgtttgaggtgttcggacggggagcgtgatgccgccggccgttttaatgacctgatttgactgaaccagctgattgacatctctatataccgtcatttccgaaacgccgaaccttgcgctgatgtcagaaattctaagcgagccttcttctttcagccacttcagtatgtgttgctgtctattaatcggaagcattcatacaccctcttcattaagatctatttaagcgtagaggattttagagacggagacaagtaagtggatgataaaaaatgtgaaaatgtgttgaacagcaacaaaacgaaacagaagggactctggtataatagacagatggaatagaaagtgaggaataccctatgaaagaaacaccatgcccgaactgcggcaaacctttgacaggcgatatggtcagatcatcaaatgtgccttgtcaatttcgctgcggccactgccgggaacggctttatgaatataaagtttcagctccgattatgctggtatcattagcggccatcgtgctgcttatttatcttttgatgctcctccgcaatgcggcaggctcagtgctgccagctgtacagcacgtgccgatggctgtatttgcgcttgtgtgcgcgtatcccgtttttattgtgagtgagcggatgattacaaagtacgtgattcaaaatggcaacatcatttatagaggaaagagaaaaggctcctgaaaccaggagcctttttatttttaaaaaattgtcacagtcatgtgccaaagtcctctttactttcaattgtatagggactgtaagcgttttaacatagagtcaaagggaagcatcattctctgaacatatttttgtatcttacagcgacaaacaaaacagggagggtttatatatgcagcagcaagaacagcagcaaggcggcatgaaagtgaaagtgcaacgctttgggagttatttgagcggaatgatcatgccgaatatcggcgcgtttatcgcgtggggtatcattaccgcgctgtttattccggcaggatggtttccgaatgaacagctgaacacgctggtcagcccgatgattacgtatttattgccgcttttgatagcgtatacaggcggaaaaatgatctacgaccaccgcggcggagttgtcggagcgacagcggcaattggggtgattgtaggatcggatattccaatgtttttaggcgcaatgattatgggtccgcttggcggatacctcattaaacagactgataaattattcaaggataaagtcaagcaaggctttgaaatgctgatcaacaactttacggcagggattgtcggcgcggctttaacgattctcgcgttttacgccatcggcccggttgtcttgacgctaaataaattgctggcggctggtgtggaagtcattgtacacgctaatttactgccggtagccagtgtttttgtagaaccggcgaaagtgttgttccttaacaacgccataaaccatggaatcttaagcccgatcggaatcgagcaagcatctcaaacaggaaaatcaattctgtttttagtagaagcaaaccctggaccggggctcggcattttgctggcctacatgttctttggcaaaggatcttcaaaatcaacggctcccggtgcggcgatcatccatttcttcggagggattcacgagatttacttcccgtacattctgatgaaaccggccctgattctcgcagccattgccggcggagcaagcggactcttaacatttacgatctttaatgccggacttgtcgcggcagcgtcaccgggaagcattatcgcattgatggcaatgacgccaagaggaggctatttcggcgtattggcgggtgtattggtcgctgcagctgtatcgttcatcgtttcagcagtgatcctgaaatcctctaaagctagtgaagaagacctggctgccgcaacagaaaaaatgcagtccatgaaggggaagaaaagccaagcagcagctgctttagaggcggaacaagccaaagcagaagaagcgtctgagctgtctcctgaaagcgtgaacaaaattatctttgcgtgtgatgcgggaatgggatcaagtgccatgggggcatccatcttaagaaacaaagtgaaaaaagcggagcttgacatcagtgtgaccaacacggccattaacaatctgccaagcgatgcggatattgtcatcacccacaaagatttaacagaccgcgcgaaagcaaagctgccgaacgcgacgcacatatcagtggataacttcttaaacagcccgaaatacgacgagctgattgaaaagctgaaaaagtaatcttatagaaagagagtgattgtcatgcaagtactcgcaaaggaaaacattaaactcaatcaaacggtatcatcaaaagaagaggctatcaaattggcaggccagacgctgattgacaacggctacgtgacagaggattacattagcaaaatgtttgaacgtgaagaaacgtcttctacgtttatggggaatttcattgccattccacacggcacagaagaagcgaaaagcgaggtgcttcactcaggaatttcaatcatacagattccagagggcgttgagtacggagaaggcaacacggcaaaagtggtattcggcattgcgggtaaaaataatgagcatttagacattttgtctaacatcgccattatctgttcagaagaagaaaacattgaacgcctgatctccgctaaaagcgaagaagatttgatcgccattttcaacgaggtgaactgacatgatcgccttacatttcggtgcgggaaatatcgggagaggatttatcggcgcgctgcttcaccactccggctatgatgtggtgtttgcggatgtgaacgaaacgatggtcagcctcctcaatgaaaaaaaagaatacacagtggaactggcggaagagggacgttcatcggagatcattggcccggtgagcgctattaacagcggcagtcagaccgaggagctgtaccggctgatgaatgaggcggcgctcatcacaacagctgtcggcccgaatgtgctgaagctgattgccccgtctatcgcagaaggtttaagacgaagaaatactgcaaacacactgaatatcattgcctgcgaaaatatgattggcggaagcagcttcttaaagaaagaaatatacagccatttaacggaagcagagcagaaatccgtcagtgaaacggtaggttttccgaattctgccgttgaccggatcgtcccgattcagcatcatgaagacccgctgaaagtatcggttgaaccatttttcgaatgggtcattgatgaatcaggctttaaagggaaaacaccagtcataaacggcgcactgtttgttgatgatttaacgccgtacatcgaacggaagctgtttacggtcaataccggacacgcggtcacagcgtatgtcggctatcagcgcggactcaaaacggtcaaagaagcaattgatcatccggaaatccgccgtgttgttcattcggcgctgcttgaaactggtgactatctcgtcaaatcgtatggctttaagcaaactgaacacgaacaatatatcaaaaaaatcatcggtcgctttgaaaatcctttcatttcggacgatgtgacccgcgtagcgaggtcacctctcagaaaactgggagaaaatgatagacttgtaggcccggcaaagaaaataaaagaaccgaatgcactggctgaaggaattgccgcagcactgcgcttcgatttcaccggtgaccctgaagcggttgaactgcaagcgctgatcgaagaaaaaggatacagcggcgtacttcaagaggtgtgcggcattcagtcccatgaaccgttgcacgccatcattttaaagaaacttaatcaataaccgatcacccgtgacacaatgtcacgggctttttttactatctcgcaatctagtataatagaaagcgcttacgaaaacagggaaggagaatgacgatgaaacaattcgagattgcggcaataccgggagacggagtaggaaaagaggttgtagcggctgctgagaaagtgcttcatacagccgctgaggtacacggaggtttgtcattctcattcacggcttttccatggagctgtgattattacttggagcacggcaaaatgatgcccgaagatggaatacatacgcttactcaatttgaagcggtttttttgggagccgtcggaaatccgaagctggttcccgatcatatatcgttatggggactgctgctgaaaatccggagggagcttgagctttccattaatatgagacccgccaaacaaatggcaggcattacgtcgccgcttctgcatccaaatgattttgacttcgtggtgattcgcgagaacagtgaaggtgaatacagtgaagtcggcgggcgcattcacagaggcgatgatgaaatcgccatccagaatgccgtgtttacgagaaaagcgacagaacgtgtcatgcgctttgccttcgaattggcgaaaaaacggcgcagccatgtgacaagcgccacaaagtctaacggcatttatcatgcgatgccgttttgggatgaagtctttcagcagacagccgctgattatagcggaatcgaaacatcatctcagcatattgatgcgctggccgctttttttgtgacgcgtccggaaacgtttgatgtcattgtggcgagcaacttgttcggtgatattttaaccgacatcagctcaagcctgatgggaagcatcggcattgcgccttctgcgaacatcaatccatccggcaaatatccgtccatgtttgaaccggttcacggctcagctcctgacattgccggacagggccttgccaatccgattggccagatttggacagcgaagctgatgctcgaccacttcggagaggaagagctgggggcgaaaattctggatgtaatggagcaagtgactgccgacggcatcaaaacacgcgacattgggggacaaagcacaacggctgaggtcactgatgaaatctgttcgcgcttaagaaagctctgatgaatcaggccggggcagatggctgcccgggcctgtccatttccttacgaaaatttccacgaaagtctaaccaagtagatccaaatgctgtataataatttggaattcttaggaaagcatcgggtgaaggaagttgaatgcaaaaacaatcacgttaaagaaaaaaagaaaaatcaaaacgatcgttgtactcagtatcattatgatcgcagctctcatttttacgatcagattggtgttttacaagccttttcttattgaaggatcatcaatggctccaacgcttaaagactcagaaagaattctggttgataaagcagtcaaatggactggcgggtttcacagaggcgacatcatagtcattcatgacaaaaagagcggccgctcatttgtcaaacgtttaatcggtttgcctggtgacagcattaaaatgaaaaatgatcagctatacataaatgataaaaaggtggaagaaccatacttaaaggaatataaacaggaggtcaaagagtcgggtgtaaccttaacgggtgacttcgaggttgaggttcctaccggtaaatattttgtgatgggagataaccgtctcaattcactggatagcagaaacggaatgggcatgccttctgaggacgatatcatcggtactgaatctctcgtcttttatccattcggtgagatgagacaggcaaaataaaactcagtgcaacaaagaacatggaacgtacggcacgcgataataaagcgctgtaagcgattaaaaaatttctgatgaaacagggcggagccgtttttccgccccgttttttatgatagagagcgttttgaagaaaagggccctgttgaaataaacagaatcaggattggcgaagccgtgaagcgcatcgaattgataaatctcaagatgggtatgctgtttttcccgcagttttttgataagaagcgttacgtcaaacgacggctcataattagggaaaaacaataggaccgggcaggctggcacgtgatgaagagagtcgcgtatccgggaaccgtaataacaaaccgatccgctcacctcaggcatactgctgcatttccatgcgatagtagcccccacgctgaatccaatcacaaagatgtgccgtccggcgttttgtctgatcacattctggatgatggtttctcccgttttcagccgttcgtgttttgtaaattgttcgtatgccgttttttcttcttacagtgtgtagacttcatcctcgccgagcaggttgggcgtcaacacatcatatccagccattttgatcagccggcccatctttttcatatggctgtttacaccgtatatttcgtgtacgagaatgacaagcggttttggggacataacggcctccttttgtgtttttcccattatatcctatcgtttcactttaggctgagatataatggtcaaaaaaggagatataaaatgaactcattacctttgcctcaccgctatccatttatgtttattgatggcgtgacggatagcgagcccggcaaacatgcggcagcttataagctgattagtgagaacgattggtttattactgatacgcaaacagaaatgccgttttcacttgtgattgaagcgcttgcgcaaaccgcggcttttacaggaattacagatgagaacagcttgggattattgtcttcggtgaagaaagcggaaaagctgggagaagctgtgcctggtgaccggcttgatcttacgtttgaagtcacgcgcaatcggcgcgggtttgtgttcggacatgccaaggcatcagttggagagcagcctgttgctgaagctgaaatcggcatctatattgaaaaatgaaaaaaacccttcacaacattttgtgaggggttctattttgtgtcgtaatcccgttcgctttgagagttatctctttgctggcgtttgtgtttttcatcattcatattttccttcagctcttcattaggaatcggatcggttaagtcgttgtgctgggggttttcatttggtttgttttgctgttttttttctgtcatgtttgatcacctcaccgtttgttttcctcttatccattctcctcaaacataggaaatcgcttttttgtcccgctgggtataatgtattagaatagagagaagcacaacaaaaagataaagagaggtacatatatgtctgttcaaagagaagatgtagatatcaagctgatcgcaattgatatggatggtacactgctgaacgacgagcagctgatctcggatgaaaaccgcaaagccattcgtgaagcggaggataaaggtgtgtatgtggtgatcagcacgggccggacgctgatgacgtgccgggagctggcggaatcgctaaagctgtcatcctttctaatcacggcaaacggcagtgaaatttgggattcgaattttaatttggtggaacggaagctgcttcatacggaccatattcaaatgatgtgggatttgcggaataagcacaacactaatttctgggcttctacggtgaataaagtatggagaggcgagtttccggaaaacattacggatcatgaatggctcaaattcggctttgacattgaggatgacgatatccgaaacgaagtgcttcaggagctgagaaaaaacaaagagctcgaaatcacaaattcaagtccgacaaacattgaagtcaacgcgcttggcatcaacaaagctgcagcccttgccaaggttacggaaaaactcggcattacaatggagaatgtgatggcgatgggcgacagccttaatgacattgcgatgatcaaagaagcgggtcttggcgtcgcaatgggcaatgcgcaagacatcgtaaaagaaacggctgattatatcacggatacaaatattgaggatggtgtcgctaaagcgattcgccattgggtactataaaaaaagagagtcctaagatggactctcttttttagtttggcaggttttcttctgggaccatggtaggttttctgacaaaagtatttcacaaactgatatgattcacttataatgaaataaagttcaaaaattcggaatagtcgttccgaatttcgggacaataaatgacataaagcatatcgtttgctttggcaggagggattctgtgtttcagattgatttaaactgtgatttaggagaaagcttcggatcctacaagataggtcttgaccaagatattttagagtatgtgacatcagcgaatatcgcatgcggatttcatgcaggagatcctagtgttatgcgaaaaaccgtcgcgcttgcagcggaaaaaggcgtaaaaatcggtgcgcatccgggcttgccggatttactcggttttgggcgccgcaatatggcgatttctcctgaggaagcgtatgatcttgtcgtttatcaaattggcgcgctctctggctttctaaaagcagagggacttcacatgcagcacgtcaagccgcatggcgctttatacaatatggcggcagtcgatcaaaaactgtcggatgctatcgcgaaagctgtctataagattgatccaggcctgattcttttcggtcttgctgagagtgagcttgtaaaagcgggagaacggatcggacttcagaccgcaaatgaagtgttcgccgacagaacataccaatcggacggcacgctgacaccgcgctcccagccggacgcactcattgaaagtgatgatgccgccgtcacccaggtcatcaaaatggtgaaagaaggggcggtcaaatctcagcaaggacatgatgtgtcattaaaagcagatacagtctgcattcatggagatggagcccatgcgctgacatttgcgcaaaaaatcagaaaacagctcaaagcggctgaaattgaagtgacagctatttcagaacagaagtcaacataaaggaggaacaatagatggagcagcagaaaaagacagcaggaaaaaaagcgggaagctggtcattgctgatgggcgccgcctttttaatggcgacatcagcaatcggaccgggtttcctcacccaaaccgcaacattcacaaacacactcgcagcaagcttcggttttgtcatcttaatctctattattttagatattttcgcccaaaccaatgtgtggcgcatcatcgcagtttctggaaaacgaggtcaggaaattgcgaatatggtgcttcccggactgggatatttcatcgccattctcgtcgtgcttggcggactagcttttaatattgggaatatcggaggggccgggctgggacttcaggtgctgttcggcattacacctgaaacaggcgctttaatcagtgccgttatcgccattttgatttttgtcatcaaggaagcaggaaaagcgatggaccgttttacgcaaatcgcggggttcgtgatgattattttaacggtctacgttgcggcgacgacagctcctccggtcggacaggcagtcgcaaatacattcgtcccggaacacatcagcatatttgccattgtcaccctagtgggcggaaccgtcggcggttatatcacatttgccggaggacaccgtttgcttgatgccggaattaaagggaaggaatccattccgcaggtgacaaaaagctcggttgtcggcattttaattacatctgtcatgcgtatcgctctttttcttgcggttctaggcgttgtatcgaaaggcctgcacatcgatgaaagcaacccggcggcttctgtcttcaagctggctgctggaaatgtcggttataaaattttcggattgatcatgtggtctgcggcgattacgtctgttattggagcagcctatacatctgtttcatttttcaagaccttttctccaaaaattgaaaagaattcacgtggtattattatcggatttattgtggtttctacgttagcttttgtcacaatcggccagcctgcgaagatcctcgtccttgtcggttcactgaacggcttaattctgccgattgcgctcggaacgctgcttgttgccgcctacaagaaaaacattgtcggtgattataagcatccgctttggctgacaagcacaggcgcgcttgtagtgattgtaatggcagttatgggaatctacacgttatgtacacaacttcctcaattgtggagctgatataagtggagcaattaaacaaaatggcgccgaaggatgtacgcgccctgatacgagaggggaaaataaacgggccgaccgcaggcatgtccggcggctacgcccaagcgaatcttgtggttttgaaaaaggacctagcttttgattttctgctgttttgccagcgaaatcaaaagccctgccccgtgctggatgtgactgaagcaggttcgcctgtgccgtctctggctgcgcctgatgctgatatcagaacggactttccgaaataccgtatttacaggcacggtatcctaacggaagaagtatctgatattacgccatactgggaggacgattttgtcggctttctgatcggatgcagtttctcctttgaacaggcactgatcaataatgggatagctgtccggcatattgatgaggggacaaacgtctcgatgtataaaacgaatatcgattgtgttccggcgggggcgtttcacggacagatggttgtcagcatgaggccggttcctgaacggctggctgtacgtgccgcacaagtgacctcgcgttttccggctgtgcacggagggccgatccatatcggcaatccgggagcaatcgggattcgcgatctcgggaaaccggatttcggagatgccgtttccattcgtgacggcgaggttcctgttttttgggcatgcggggtgaccccgcaagccgtggctatgaatgtaaagcctgaaatggtcatcacacatgcgccggggcatatgctcatcacagatattcgagacgagtcgcttgcggtgctgtaacctctcgtcatcctgatgaacgagaattaaaagaggtgagaaagatgactgtacgatatcaaatcgaacagctcggtgattctgcaatgatgatccgattcggagaagaaatcaatgaacaggtcaacggcattgtccacgccgcggccgcttatatagaagaacagccatttccgggattcattgaatgtatcccggcttttacaagtctaactgtattttatgatatgtatgaagtgtacaagcatttgcctcaaggcataagctcaccttttgagaaggtcaagtgcgatgtcgaagagcgcctggcagaaatagccgaagactatgaggtcaaccgccgtattgtagaaattcctgtctgctatggcggtgaatttggtccggatttagaagaggtggcgaagatcaatcagctgtcaccggaggaagtaatcgacattcatacaaacggtgaatatgtggtgtatatgcttggcttcgcgcccggttttccttttctaggcgggatgtcaaaacgcattgcagctccgagaaaatcatcgccaagaccgtcgattcccgcaggttcggtcggtattgcgggattgcagacaggcgtttacccgatttcaacgccgggcggctggcagctgatcggcaaaacgccgctggctcttttccggccgcaggaaaacccgccgacattgctgcgggcgggagatactgtgaaattcgttcgcatctcagaaaaagactatcacgcctataaggaggagtccaattgagcatgaaagtattaaagcccggactgctcacaacggttcaggatataggcagaacgggttaccaaaaatacggcgttctggccagcggcgctatggacacggtatcactgcgcattgccaatttgttgataggaaacggtgaaaatgaagcaggtctcgaaataacgatgatggggcccggtccgtcgtttcatttttcaaaacagacactgattgctgtgacaggggcggacttcacgctgcgtattaatgacgaggaagcgcctttatggaagcctgtgctcattaaggaaaacagcacagtcagctttggcccctgcaaactcggcagccgtgcttatttggcggcagccggcggcatcgaggtgcctgccgtcatggatagtaaaagcacatacgtcagaggaagcatcggcggacttcatggcagagcgcttcaaaaagaagatgaactgaacattggagagatgtcagctctttcgcaaaccatcctttcccgcttaagttcgctgcttggaaaacagggatttgcagcaccgaagtggtcagtcagccgcggcagatttctgccattgaagaagaatcccgttattcgggtgctggaaggaaagcaatttgcctttttcacagaagaatcaaaaacgcgtttttatgaagaagcatttcgtgtcacgccgcagtccgaccgtatgggctacaggctcaaaggagaaccgctcgaactgaaggccccgcttgagatggtgtcggaagcggtttcattcggaacagttcaggtgccgcctgacggcaacccgattatcctgcttgcagaccggcagacgactggcggctatccgaggatcgcgcacatcatatccgctgatcttccgattgtttcccaaatcatgccgggtgagcacgttcagtttgagcctgtgtccctccaggaggcagaagcgcttgcggtagaacgggaacagcatataaaagaactgaaaacgagaatgaagatggaatggctgacatagcaaaggggatgaatgatgcagaataaaaataaaaccgtagtcaaatctatggcgctgcttaatttgtttttgcataaaccaagcctaaccttaagtgaactggtgtcgctgacgggaatgccgaagacctctgttcaccggatggtcagctccttggaggaaatggggttcctcagtcgggatgcgtccggcgcttattcgctgggattggtgtttttggaattcggacagcttgtcgctgacaggctggatatcagaaaaatagcgaaaccggtgatggaagagctgtgccgggaagtggatgaggccgtgcagttgatcatgagggacggcaatgaagcgatatacgttgagaaaatagaagggacacagactgtgcggctgtatacggcgatcggcaggcgttcccccctatacgcgggagcgtgcgccagaagcattctgtcctttcttccccgtgaagaaatcgaagcatacatcaaacaaaccgagctcatttcgattggctccggaacgattaccgatcccgaaaaactgcttcaggagattgatgcctctgtgcaaaatggctatactgtcagctattcagagctcgaaaactatacggcggcgatcggcgccccgatctttaatcataagcgccaagtggcagccggcattagcattgcaggctttgaagcgagatttacagaagacaggctgccctatttaacagaaaaggtgaaggacgccgctttacagatttcaagaaaaataggatatacataagtagccaatcttttctctgctgcgtacattaacgtatcgacgttcaagagtggaggaaagaacatgatgcttcgatatacagctctgggcgattccttgacgacagggagaggctccgggctgttttcacccggcttcgtccagcgttttggggacatgatggaagctgacttgaaaacaagaacggcaataaacatatttgccagatcaggtctgaatacagaagagattttgggactcctgtcatatccctatgtgcaaaaatgtattcgagatgctgatatgataacgatcacagggtgcggaaacgatctcatcgattcggtcttagcctaccaaacctctaaggatgaaacgattttcagccgtgtatccgcccattgccatgagaattttgaaaagatgattgccaaagtcgccgagattaaaggagaaaatccttccccgtacgccattcgtgtgttcaacttatacaatccgtttcccgaaattgatatcgccggcaaatggatcacttcgtttaattcacatttagaaacacttgcatcagcaccccatgtcaaaatcgcggatgcctatagcatcttcaaaggcaaagaacaggaatatctgtcctttgacggtgtccatccgaacagcaaaggctatcaagcgatggctgaagccgttcacaagctaggctataaagaattatcagtttcatagaaaacgcgcctcatgacaggcgcgttttttatgtgtgatcgaaatattaaaagaaacttaaaattctctgtcttctgttctacagacaaacaaagtgcgctagaataatggagggcgtaggcaaatatagccataacgttcaatatttcgtatataaggaaggatggtccttttgtttcggatttttaaaatgtcttttgcggttatcattattatactggcgcttattgcttttaactatacggaacacacctctgttatccaatcggtcatgctcgtctttcttggtgcggtcatgtttatgcaggggcttgaagaacgcaaaaaagaaaatgacggctcaggcgcttttaatatttataccgccgtttttgtatggtctgtctcccttatcggttttacacttcatattatataaatctattacacatcctgaaaatgctcgaccgtcgggaacggggtatagaaccgatgaagcaaggctttccactcttgatactctgaagaaccgcgaaagccttccgtatggtcctcaagtgtttcccactccacaagaagcagatatttatgcgtttcctccatgcattttgataacgagtgagtgatatagcccttcatgccggaaataatcggcgccgcttgccggaatgcatcctcaaactcttgttcaaggccttctttaatgtgaagcattgctgcctccctgaccatgcgatcccttctttctgtcttttcaaatagtctacagcaaacgataggagatttctgcaaaatcggtgaacttttccttcattttcaaaaaaatcttgcacgcaccaattcaattaagagaaaataacaagtggaaggcaggggaaagtcatgttaaaaaagtgtattctactagtatttctatgcgtcggattgattggattaatcggatgctccaaaacagattcaccagaggatcgcatggaagcattcgtgaaacagtggaacgatcagcaattcgatgacatgtatcaaagcctgactaaagatgtcaaaaaagaaatctccaaaaaagatttcgtcaacaggtataaagccatctatgagcaggccggcgtaaaaaatttgaaagtcactgcgggagaagtagataaggacgatcaagacaacaagacaatgaaacatatcccgtataaagtcagcatgaacacaaatgccggcaaagtcagcttcaagaatactgctgtgctgaaattagaaaaaacagatgacgaggagtcatggaatatagattgggacccatcgtttattttcaagcagctggctgacgacaaaaccgtgcaaattatgagcattgagccgaaacgaggccaaatttacgataaaaatggaaaaggcttagccgtcaatacagatgttccggaaattggaattgttcccggagagcttggcgataaaaaagagaaagtcataaaagagctcgccaaaaaacttgatttgactgaagacgacatcaagaaaaagctggatcaaggctgggtaaaagacgattcgtttgtgccgctcaaaaaggtcaagcctgaccaggagaaattagtttctgaagcgacgtcattacaaggcgtaacaagaacgaatgtcagctcccgctactatccgtatggcgaaaagacagcccatttgacaggctatgtccgcgccattacagcggaagaactgaagaaaaagaaagaaggaacgtacagcgatacgtctaacatcggtatcgccggacttgaaaatgtgtatgaagacaagctaagaggcacaactggctggaagatctacgtgccgcaaaccggggaagtcatcgctgaaaagaaagcaaaggacggcgaggatcttcacctcacaattgatatcaaaacgcaaacgaagctgtatgatgaactgaaggatgacagcggggcggcagtcgcgctgcagccgaagacaggcgaaacactcgcccttgtcagcgcgccttcctacgatccaaacggatttattttcggctggagcgataaggaatggaaaaagctaaacaaagataaaaacaatccgttttcagcgaaattcaataagacatacgcgccaggttctaccattaaaccgattgcggctgctattggaatcaaaaacggcacccttaaagccgatgagaagaaaacaatcaaaggcaaggagtggcaaaaagattcgagctggggcggctattcagtgacacgtgtatctgagagacttcaacaagtcgatttggaaaacgcccttattacgtcagacaatatttattttgcccagaatgcgcttgatatgggagcggacaccttcacaaaaggcttaaaaacattcggtttttcagaggacgttccgtatgaattcccgatccagaaatcgtctattgcaaatgacaagcttgattcagacattttgcttgcggatacaggctatggacaagggcaaatgcaaatgtctccgcttcacttggcaactgcttacacgccatttgttgacaatggagaccttgtcaaaccgacgctgatcaaaaaagattcacaaacagctgatgtttggcacaagcaagtggtcacgaaggaaggagcggcagacattacaaaaggtctgaaaggcgttgtggaagatgagcgcggatcagcgtatcagcctgtcgtgaaaggaatcacagtggctggaaaaacaggaacagccgagctgaaaacatcaaaagatgataaagacggcacggaaaatggctggtttgtcggctacgattacaaaaacaaagacctgcttgtcgccatgatgatccaaaatgtgcaggaccgcggcggcagccactatgtcgttgagaaagcgaaaaagcaatttcaatcgaattaaaatgtctttttaaaaggagcgaaaggaaaaaggagatctgaggccgaatgaactagtaaggggcaaaacccggtttatacaaagaaaagagggattttgcatgcagcgtattcaattggcggaggatcttcaattttcaagagtcatacacgggctttggcggctgaatgaatggaactattcagatgctgaacttctgagcctcattgaatggtgtatcgatcacggcatcacgacctttgatcatgcggatatttatggaggctatacgtgcgaaaagctgtttggaaacgcccttgccctttcgcctggattaagagaaaacatagagctggtcacaaaatgcggtatcgttcttgaatcgcctgaacggcccgctcacagatcgcatcattataacacaagcaaatcgcatattttggcatccgttgagcaatcgcttatgaaccttaggacggattatatcgatgtgctgttgattcacagaccggacccgctcatggatccggagggggtagcagaggcgtttcaggccttgaaatgctctggcaaggtcaggtactttggcgtttcaaattttaaagatcaccagtatcggatgctggaatcatatttgcctgagaagctcgtaaccaaccagattgagctttccgcatacgaattagaaaatatgctcgacggcactttgaacctctgtcaggaaaaacggataccgccgatggcttggtcgcctctggcaggcggcaaagttttcactggtgacacggaaaaagaccggcgtgtccgcacggcgcttgaatccgttcaagcagagattggcgccgcttcattggacgaggtgatgtacgcatggctgtatacgcatccggccgacatcatgccgattgtcggaagcggaaagcgcgagcggatttccgccgcgataaatgcgttgtcatacaagcttgaccaggatcaatggttccgcatttttacagccgtacagggttacgatattccataaaaagcatcagcttaccagctgatgctttttcaatattgtcacaccgcatagtgccaaattaccatttataagtgattgattctttcttgaaagcgttttatattaaaaggaaacctctctatatcctctactgcatctccttgcgacttcatccgcacatcaagattgtctaggaggtcttttttatgtatatgactgccagagaacaaaagctgttaaagcacttattattacaaaacagatatataaccgtaactgagcttgctgagctgatgcaagtcagcacgagaaccattcacagggaactcaaatcaattaaaccgctgatggaaaccgtggggcttacgttagataaacagcccggtaaagggttgaaagcagtgggaagtcccgaggataaacaaaagctgcttactgatttatcatatgaacagcatgaatacagcgccgacgaacggaaactgctcattctttgttcgttattagagtctcaggagcccgtcaaactgtacacgcttgctcatgatctccaggtgacgaatgccacggtcagctatgatttagatgagctcgagaagtggatttctcccttcggactgacactgatccgcaaaagaggttttggcatccagctcatagggccggagaatgcgaaacggaaaattgtcggcaacttgattgtgaaccgtctcgacatccaaatgtttttggaagcggttgaattaaacatcaaaggaaaaaccgattcttcagagaaaatgttcggggttgtcagcaaaggtgagctgctaaaaatggagcgcatcttatttcagctcaaagaaaaaatcgctttttcattgtccgacagctcctatatagcgctcgtcgtccatctgacgtatgcgatcgaacgaattaagcttggggaaaccatcaccatggagcaaaatgagcttgaggaactgaagaatgcgaaggaatccagctcggctcttgaaatcgcgggcgagcttgaacgtgccttcggcgtgacgattccagaggcggaggtcggctatattacaatccatcttcgaagcgccaatcgaaaatacaaaacagaatacaaagcgcaggaaattgagctggaaacagccctgcaaacaaagcggctcattgcttttatttcagacaaaatcagaatggatctgacgaaaaactactctttatatgaaggcttgattgcccatttggagccggccgtcagccgcataaaagaaaatattgagatatacaatccgatgaaggaacagatcaagcgcgattattttctgctttatatggcgatcgaagaaggcgttgaaaagtattttccgggcatgtccttttctgatgatgaaatcgcttttatcgttcttcactttggctcggctcttgaaatcaaaaaagaagaagcaaaagtgaaagcgcttgtcgtctgctcaagcgggatcggctcctcgaaaatgcttgcctccagactgaaaaaagagctgccggaaattgaatcgtttgatatgtcatccctgatcgagctaaaggggaaggatgttcaagcctatgatatgattgtgtccactgtaccgattccttatgaaaacattgattacatcatggtcagcccgctattaaatgaggaagacgcaaaccaggtcaagcagtatatcaagcggaagattccccttatacttaacaaaaaaagaagcccgaaggaagaggcgcagcaagctgatgtacctgacatgctggaggcggcggaaagcatagggcggtatatggaagttatccaagatgttctgcgccattttacgctagctcaactcaaaacaaacccggaccatagcatgcttctgctagagctttttcaacagctgaagaaggatggcctgatccgtgatccggaaaaagctgcgttttgcctggctgaacgggagaaacaagggggattgggaatccccggaacaaacatggcgctttatcatctcaaaaatgatgaaatcgtcctgccttttttcaaaatgtttgatctcagcacctcctatgaagtggatggcatggacggaaataccctcaggatgacacgcattctcgtcatgatggcgcctggctcattatctgctgaaggctcagagattttaagcgcgatcagctcggcaattatcgagagcggagaaagcatggcggggtttcaggaagaaggagaacaagaattgtatcagcggttaaaccgcatatttttcacatggatgaaagaaaaaaacatactgtaaacctgcatggcacacgtcaaaaatttggcgtgtgtttttctgtggatggggaacaaaataagaaaatgtgggactattttatcattcagtattggaataattccaaaatgaaatagttttacaagttatcttttttgggttaaaatgggtgaggtaaggaagaaaatctaacaaattattgaagattcaagagaatataggagatgacgatatggaaacattacagcatctgattctgcatgacatgccgaatagcgaagaaatagaggctgtaaaaagcggagaccatacactgacatataaaggttaccgtaaacggattaatcagctggcgaatgccatgcttcaaaaaggaattcaaaagggcgaccgtgttgcattgctttgcaaaaacggccatcccgcatcaactgttatgttcgccgcgcttgaaataggtgctgttgtcgtacctgtcagctggcagctgaaaccatatgaaatgacaggcattttaaaagcaagtgaaccgaaagcgatgttttacggagcggagtttaaagagatactggatgaagttctacctgaattgtcctcactgtgtgtaacaatggaaacaggaacagcttacgaaacatctgctgaatttgaagcgctgtttgcaggtcctgatcatttgccagagacggaaatggtttcacctgatgatacagcacttctgatgtttacatctggaacaacgggaaacccgaaaagatgcatgattacacatggcggcatatacagatacgttaaaaaatccaacagctcaatagcacgtatgaagggccttcgttttctcgcgtgccatccgatttatcatacgagtgcgctcatttgcatcatgcttggaacgtttgcagaaacaacctttgtgtttacaaaggatcaagatcctgttcacatgctgaaggtcattgaagaagagaaaattcagaccgtgatggctcttcctgtgttttacacgtatttgcttgaggcgtgggaaacgcaccaaactgacttatcttcacttgttattttaatgacaggcggaacaaaagtgccgagcagcctaatccgccgctatcttgatattggcattccgctcgcgcatggctatggaagcactgaggcttggggcatcagcacatggacgcctgatatgggaatggataaagcggcatctgcaggaaaacctgtggcaggtgttaaagtcaaagtggaagatcctctgaccggagaagaacttcctcaaggagaaatcggcgaaatcgttgttcatactccattcttatttaaaggctatgaagacaatcctgaagcaacagcgaaagtgctgcaaaatggatggtttagaaccggagattcaggatatgtagatgaagatggctttattttcatcacgggacgctacaaggatgtcattatttacggaggcgataacgtctatcctgatcaggttgaagaagttatccagcagatcccgggaatccttgaaacggctgtggtcggtattccagacccgctttacggtgaaaaaccgaaagcttttatcgtgaaaaatggcggccagcgcatcacagaagaggatgtcatcgcattttgtaaagaacgcctgtccgcttacaaaatacctgaagttgaatttgttaacgaactgccgaaaaacaaccttggcaaggtgaaaaaagacgtcctgcgcaatcaggctgtacattcataaaagaagaagcccgtccactttatgtggcgggcttctttgcacttgcacagacggaaagctcaggcttaatgttcttaaattgtatatcaatgtcttcgaagccggctgctttaaagtcagcaatcatctgtcttccaaatgatttggttttttcaggactggcatccgcttcccgcggctgcatcgtaatggctgctttgccgcctggctttaatgcccgataaatctgtttcatgccttttgtttggtcattccaaatggtgtagttgttaacggaaatcactttatcataaaacgaggcggggagaggaaatgtctcgatgcttccttgtatcaggcgtacgccctttggtttcactctgcgggcggccagcttcagcatggcctctgacacatcaatcccatgaagatgaacatccttctcgcgtttcagcatctgctgcatgcagtatcccgggccaaacccgacttctaaaatgctgtccccgcgcgtgatacccagctgattgattgtccactgattcagtgtttgattttcagcagccatgatgtacccggcaatcatgccgatgacgccctttggcctgctgaatcttctagaaagcatgttaatcattcagcaaccaacctcctttttgagttatttcctccaagcgttccatgtgaaacatttttctgataaagcaatgcgaaggtgccaagccatgtttatccaaagagtgtgtgaggtacacaacaaatagacatgaaaacaaaggaggagaatcatcatggcaaattatccaaaagaactgccggcacaaactcaaagtcgccagccgggaattgaaagcgaaatgaatccaagtccggtgtatgagtacgaggattataaaggagcagacaaattaaaaggaaaagtagctcttattacaggcggcgacagcgggatcggacgcgcggtttccgtcgcttacgcaaaggaaggcgcagacatcgccattgtgtataaggatgagcatgaagacgctgaggagacgaagaaacgtgttgaacaagaaggcgtaaaatgcctgctgattgctggtgacgtaggtgaagaggaattctgcaatgaagcggttgaaaaaacggtcaaggaactaggcggccttgacatccttgtcaacaatgcaggtgaacagcatccgaaggaaagcatcaaagatattacgagcgaacagcttcaccgcacattcaaaacaaatttttattctcaattttatttgactaaaaaagcaattgattacctgaaaccgggcagcgccatcatcaatacgacatccatcaacccgtacgtagggaacccgacactgattgattatacagcgacaaaaggggcgatcaatgcctttacaagaacaatggcgcaggcgcttgtcaaagacggcatccgtgtaaatgcagtcgcgccgggtccaatttggacgccactaatcccagctacgttccctgaagaaacagttgctcaatttgggcaagatacgccgatgggccgtcctggacagcctgttgagcacgtcggctgttatgtgcttctggcatcagatgagtcctcttacatgacaggtcagaccctgcatgtcaacggcggaaactttgtgacgacataagagggagtgagacatatgggcatcacgaaagaagaagtgaacagctactatcaaaaagcagggattgtattaacggacgaggaagtagaccaaatccagctgatggattacggcttaggaaaagaaagaaaagtcgggctccagctcttcgtctacgtcaatacagaccgttattgttcaaaggaattggtgctgtttccgggacagacttgcccggaacaccgccatccgccggtcgacggccaggaaggcaagcaggagaccttccgctgccgctacggaaaagtgtatctttacgtagaaggagaaaaaacgccacttccaaaagttctccctcctcaggaagacagagaacactatacggtctggcacgaaattgagctagaaccgggcgggcaatatacaatccccccgaatacaaagcattggttccaggccggggaagaaggtgccgtcgtgacggaaatgtcatcgacgagcacggataaacatgatatctttaccgatccaagaatataaggatgaggcttagcagcccatccttttttgtattgaaaaaaacagaatcatcgatataatgggtgaaaaaggaaagagggcgaagcgatgttcacttgcaaggtaaatgagcacatcaccatccgattattggagccgaatgatgcggagcggctggccgaactcattatccaaaatcagcagcggctcagccagtggctgttttgggcggaaaatccaagcagcgctgacacgtacagagaaaccatcattccagaatggcggcatcagtatgcagacctgaacggcattgaggcggggctcctttatgacggcagcctatgcggcatgatcagcctgcataaccttgatcaagtgaatcgaaaggctgaaatcggatattggattgctaaagactttgaagggaaaggcattattacagctgcctgccgaaaactcattacgtatgcttttgaagagcttgagctgaatcgtgtggcgatctgtgcggctgtcggaaacgaaaaaagcagagcggttccggagcggatcgggtttctagaggaaggaagggcacgggatggcttatacgtaaacggcaggcatcacgacctcgtctactacagtctgttaaagcgtgaatgggaaggcgaaaaataaagagcacactttcttgtttaaatcttccccggatgtggaaaagtaacagcggagacgttaaaaaggagtgattcgagatgaatcagcaagacattaaacaaaaagtgcttgatgttctagatcaccataaagtaggttcgctcgcaacagttcaaaagggcaaaccgaattcccgctacatgacttttttccatgacgggctgacgatttacacaccgacaagcaaggaaactcataaagcggaagaaattgagaacaaccccaatgtccacattttattaggctatgattgtgaaggctttggcgacgcatatgtcgaagttgccggaaaagccaaaatcaacaattcggcagaactcaaggacaaaatatggagttccaaattagagcgctggtttgacggcaaggatgatccgaatctggtgattcttgaaattgaaccggaggatatcagattaatgaatgccggggagaaaacaccggtctcactcgaactataaaaaatttgtgttttcaggggcgatatgttattatgaatagctagtaagaaaaataagcaaataaaaaagaaagtaaacttcttttttctgttttgagagagaagcttaccgcttcccaagcagcataaccagctgcccttattcttttccttcataacaaatcgcccctaacgatgagatggaaaaaagacttttttgttttacaattcacaccggcgcggcttcggagccgcagtgacgattgagaggtagggctttcgttgtcttgtgttcaagaaatttccatggtgtttactttccagaatgattcttcggaacaatgctttatgaatctaacccgcctgacttggcggatgatataatctttatttgcgtatagaaaagaataagacaaaccgcccggcgtacgccggacggtttttttattgcaaaaaacacatcgtactgaaacctccttgtcttctttccagtcttatctctaggatgaaattggaggaagaataacgtgcatgtcattacaacacaagtactttttattttttgttttttattgctgattcactcgatagaaaccttagcctatgctacaaggctttccggggcccgcgttggatttattgcgtccgcgctttccctgtttaatgtcatggtcatcgtgtccagaatgtcgaacatggtgcagcagccctttaccgggcatttaattgatgatgctggaaaaaacgcactggcgattgtaggggaccagttccgctttttaattttcggatcgacagtcggcaccattttgggcattatcctgctcccgtcttttgtcgctcttttttcacgggcgattattcacttggcgggcggcggcggctccgtttttcaagttttccgaaaggggttctcgaaacaaggattcaaaaatgccctttcctatttgcgtctgccgtctatttcatatgtaaaaggatttcatatgcgcttgattccgaagcgtttgtttgtcatcaacatgctgatcacatcgatttatacgattggcgtgctttcggctttatacgcaggccttctggctccggagcgcagtacgacagccgtcatggcttcgggtttaatcaacggaattgcgacgatgctactggccatttttgttgatcctaaggtatccgttctagctgatgatgtggcaaaaggaaaacgaagctatatctatttaaaatggacctctgtcacaatggtcacatcaagggtggcgggcacactcctcgcccagctcatgtttattccgggggcctactatatcgcgtggctgacaaagtggttttaataaaaaaggctggatcataaaaatccagccttttttgcgttcccttatttatatttccttaatccgcggtcgtacaaaaaatttccgaatgggacgaaagcggcgacgaagccggcagctgaccatttcagcggccatttgacagagaaggttgcataagccaagacaagtaaatacaaaatgaacaacccgccgtgaaccgaaccgacaattgtcaccgcaagcggaaggcctgcccaatatttaagcggcatagcgatgaacaacaggattaagagtgacattccttcaataaaacccatcgtgcgaagtcttccgatcggcgtttgcagcataaatcgccctccttgtggacacgttttcattttatactataaacaatctgggggggcatatgacagctttcaaaaaatgttcggaaaacattcatttttacatgccttttctagggaactgtacttgtcatttacaaaaatacccgagataatgtgtacaaaatcaaaaaagaaggatgttgaaatgaaacttgaccagattgatctgaatatcattgaggagctgaagaaggacagccgtttgtcgatgagggaattaggcagaaaaattaagctgtcgcctccatctgtgacagaacgggtaagacagcttgaatcgtttggcatcattaagcaatacacgctggaggtcgaccagaaaaaactggggcttcccgtttcctgcattgtggaagcaaccgttaaaaacgcggattacgagcggttcaaaagctatattcaaacattgccgaatattgaattttgctaccggattgcgggtgcagcctgctatatgctgaaaatcaatgccgaaagcctcgaagcggtagaagatttcattaacaaaacatcgccctacgcgcaaaccgtcactcacgtcattttctcagaaattgacacgaaaaacgggcgcggttagagagtgccgcgtgaagtctgttataataacaggatgagcgcgaaagaaagagaagtgatcaagcatgtcaaaaacagttgtattagctgaaaaaccttcagtcggccgggatttagcccgggtgctgaagtgccataaaaaaggaaacggttatctcgaaggcgatcaatatattgtgacctgggctttaggccatttggtgacgcttgctgatccagaaggctacggaaaagaatttcaatcatggcgcctagaggatctgccgattatcccagaacccttaaagcttgtggtaataaaaaaaaccggaaagcagttcaatgcagtcaaatcccagcttacccgtaaagacgtcaatcagattgtcatcgcgactgacgcaggccgggaaggtgagcttgttgcgcgctggatcattgagaaagcgaatgtccgaaaaccaatcaagcggctgtggatttcatctgtgacggataaagcgatcaaggaaggttttcagaagctgcgcagcggcaaagaatatgaaaacctgtaccattctgccgtcgccagagcggaagcggattggattgtggggatcaacgccacccgtgcacttaccacaaaattcaatgcccagctctcatgcggtcgtgtgcagactccgacgctagccatgattgcaaagcgcgaggcagacattcaggcgtttacgcccgttccgtattacggcatacgtgctgcagtcgacggcatgacgctgacgtggcaggataagaaatcaaagcagacgagaacgttcaatcaagatgtaacaagccgtttgctaaaaaacctcgaaggaaagcaagcggtcgtagctgagctgaaaaaaacagcgaaaaaaagctttgcgcctgcgctttatgatttaacggagctgcagcgtgacgcccacaagcgcttcggtttttctgccaaagaaacgctttctgtcctgcagaagctatatgagcagcataagctcgtcacatatccgcggacggactctagatttttatccagtgacatcgtcccgacgttaaaagaccgtctggaaggcatggaagtaaaaccgtatgcccaatatgtcagccaaattaaaaaacgcggcattaaatctcataaaggatatgtcaatgacgcgaaggtgtcagaccaccacgcgattatcccgaccgaagagccgctcgttctcagcagtctgagtgataaagaacgaaagctgtatgacctgattgcgaaacgtttccttgctgtattaatgcctgcattcgaatatgaggaaacaaaggtcatcgcagaaatcggcggagaaacctttacggcgaaaggcaaaaccgtgcaatcgcaagggtggaaagccgtttatgatatggcggatgaggatgatgagcaggaggatgacagagaccagacacttcctgcgcttcaaaaaggcgacacacttgccgtccgcacgttaactgaaacaagcggccaaacgaagccgcctgcccgctttaatgaagggaccttgctgtcagcgatggaaaacccaagcgcatttatgcagggagaagaaaaaggcctcgtcaaaacgcttggagaaacaggcggcctcggcacggtggcaacgcgtgccgacattattgaaaaactgttcaacagctttttaatcgagaaaaaaaaccaagatatttttatcacttctaaaggaaaacagctcctgcagcttgttccggaggatctgaaatcaccggccttaacagcagaatgggagcaaaagctgtctgcgatcgcggccggcaaattgaaatcggctgtttttattaaagatatgaaggcttacgctcaccaaacggtaaaagaaatcaaaaacagcagccaaaccttccgacatgacaacattacgggaacggcatgtccggaatgcggcaaaatgatgctgaaagtaaacggcaaacgcgggacgatgctcgtgtgccaagatcgtgaatgcggaagcagaaaaacgattgcccgaaaaacaaacgcacgctgcccgaactgccataaaagaatggagcttcgcggccaaggcgagggccaaacctttgcgtgtgtgtgcggtcaccgtgaaaagctctctgtatttgaaaaacgaaaaaacaaagacaaagcgcgtgctaccaaacgggacgtatcctcttatatgaaaaaacaaaataaagatgagccgattaacaacgcgctggcagaacagctgaaaaaactcggtttggataaataataaaaaaacctgtgcctatcgcacaggttttttattggacttaggtcctgttttcttaatgttcaaaaaggggaaaaaaagctagcaatctgcatttttttcttttatagtaaatgtactttgtaacatggcagtcatattttcgtctataactatttgtgagcgtctgatttgcttcaggcgacaaagggggatttgcctgtgaggcatgtactaattgctgtcatcttattcttcttatctatcggactttccgcagggtgtgctgaagctggaaacaagacccaaaatcagtcggcaacagaagtgaatgccagcccgctccagccggcggaatatttcatctatcacaatttaatgaatgaccaagggctgatcaaaaccgatttttcagaccagccttcttacttgtcggaatctctcggcctgtggatggagtttctgctcagcaaaaatgacgcaccgcatttccaggatcaatatcagcatctgactgattcatttctgatgagcaatcacttggtgacgtggaagattcaaaatggccaagcgagcgggacgaatgcgctgatagatgatatgagaattatgttgtctcttgaccaagccgccgcaaaatggggccgcagcgactacgcgcaaacggctaaggatatcggcacgtctttgaagacatacaatatgaacaatgggttatttacagactattacgactcacaggccgcttcaaaggatgtgacgctttcatacgtcatgcctgacgccttagctgtcttaaagaagaatggaatcatagacgaagacacagaacagcggaatgccaatgttctctattcagttcctttaaaaaatggctttctgccgaaaacatacagctcggagacgaaggaatacacatacgacagtgaaatcaacctgattgatcagctttacactgcttggcatttgccggaaggggatgaaaaagcatctgttttagcggactggatcaagcaggaatttcagaaaaacggaaagctgtacgggcggtattcggcagatacgaaggagcctgccgtccaatatgagtctccatccgtatatgcattagccgtattgtttttgacaaaacagcatgaaaacagttctgtcatcaaagccatatatgacagaatgaatgactttgaaattcatgatccggtgaaatcgtattatggaggctatatgagcggcactcagacgcattcatttgacaatctgctgccgctgttagccgaaaggaagctttttaatgaaaatatcattcagtgaatcacaaaaattatttgcttatttttcagggctcatcgcggccctgtctttgtttattaattatgtgtcagcccagcaatcagaaggtgctctgatcctttgcatcacatttggcgtcatcgccgcaggcatctggttcggcccgatttacgcgctggcagtgaccttaatcgtactctttgttctcggcaccttaatgatgtttttccagactggacaggctgcgttatttccggctgaggaaggactgcgaatgcttgtcgtgtggggaatcgcgcttttgctgttttcttttatttctggaagaatccacgatattacagcagagcttcggcgctcaataacacggcttcaatccgaaatcaaaagctatgttgctgttgacagagtgactggttttgataacaagcaaaggatgaagctggagctttcagaagaaatcaagcgggcggagcgctacggcaattctttcgtttttttgctgctgcatatgcattatttcaaagagtttaagtctttgtacggtgaaaaagaaacggaccgcctcttccaatatgtcggtcagcaaatcaggacaagcgttcgggaaacggataagaaattccgtccctctgacgagcgtatcgggatcgtgctgacgcacacgcctgctgaacatatgccagccgtcctgacaaagctgaaaaaacaattagacacgtatcagctggaaaatggaaagtatgtgtcgcttacgttccacgtctgttacttgccctaccgcaacgatatcaaaacagctgatcaatttttagaagaactggaaaacgagatgatgatgaatgaactataaaggaatcacattgctatgcgtcatgatgcttctagtttcggctattacgtcttttcccgtttctgcgcaagcgaaagatcaggacgccggtattctcatcatctactcaaccttggacggcaaagagtcgtcacaagtcaaaatgctcgatttgcttgcgggccactttacatcccatgtgacagtcaaaaaagattcagacgttgaagcgtcggatttcaaagggaaagaccatgtgatttattacggccaaacgaaaagaaagctcagcaaaaaactgctgtctcttatcagcggcgtaaaaaaaccggttgtcgccattggctataacgcaggtcaaatcagccaattttctgggctttcattagcccgcaaagaaaatgtgtttcaggttcacagcaggtcggaaaaggccgatgtgtctctggaaagcgggcttaacgtgctgagtgtatcaggcctgaaaggaacggcgctttacaccttcaaagccgatgacggcacaatacattcttttatatggaaaacaaaaaaagggaatgtgtacattggattaacaaatttgttaaatgacaatttgatcgtggcgaaacagctcagagaagctttcggagagaaggcggggacgacgttattgtatttgcgtctcgaggatatcagcccgatgtctgatgaaaaattgctgcttcaagccggtacatacctgcataagcggcatattccttttatcctggcggtcattccggtttatttgaatccggaaacaggcgacaaagtgtatttgtctgatcaaccgaagatggtcaaggtgctgaagaagctgcaaagcatgggcggcagtatcattgttcacggctatactcacgcttatcgctacagtgaaacaggagagggctttgaattttgggatgcaaaggcggatcagccgattacatccggaaatgccgaagaccccccgtccattttggagaaagaacaggacttcccgaacgaacaagcctatcacagctatctcgaaccatttcgggaaaaggaagaaacgtatacaaaacaaaaactgacgcgtgccattgaggatttgacatcatcgggtctttacccgctggcgtttgaagcgccgcattacacgatgtccgattatggctatcaaatcgcctcgcagtattttacaagcattttcggccaggtccagctcagcagcacaacatggaaaacatccggtgcacctccgtttgtgactgctccttcgatgttgcacggaatgacgctttatccggaaacgatcggctttgtcgacacatcgaagcaaaacccgttcggtgagatggaggagcacatctcccagatgattgattttgaaggcggagtagccggaggattttatcacccgtacctcgggatgaaatatctgccggagctggttgatcagatggaacgcattccagacagtgaatggcttgatttaaagaaaacgaaacaaaccgtcaaaacagacaaagtggaaattcatacaagcggtgacggaacgattcaggtgaaaaacggcgtaagcgcgattgacgagtttttcgatcatcaccggcaaacccctcttgaaaaggcgttatggattctctccgctgttgtgctcttatttgtcatcatgtttgtcagttatacgttttacttgagagccacattgaaaaaacgaatttttaaggagagaagaagccttgggtaatacgctgttctttatctcgctaagtttaatatgggttatgcttctctaccacatgtttctcatgcagggcgggtttcgccactatatgaccttcgaacggaatatcccgaagtggagagaaaacatgaaggaactgccgaaggtcagcgttctcatcccggcgcataacgaagaggttgtgattcggcagacgctgaaggcgatggtcaacctttattatccgaaggaccggctggagattatcgtcgttaatgataattcatcagaccggacgggtgatatcgtcaatgaattttccgagaaatacgatttcatcaaaatggtgattacgaagccgccaaatgcaggaaaaggaaaatcctctgcacttaactcgggttttgctgaatcgaatggcgatgtgatctgtgtgtatgacgctgacaacacgcctgagaaaatggccgtgtattacctcgtgctcggcctgatgaatgacgaaaaggcaggcgccgtggtagggaaattccgcgtcatcaatgcggcaaagacgctgctgacgaggtttattaatatcgaaacgatctgttttcagtggatggcccagggaggcagatggaagtggttcaaaatcgccacgatcccaggcaccaacttcgcgatccgcagaagcattatcgaaaagctcggaggctgggatgacaaagcgctcgctgaggatactgagctgaccatccgggtatataatctcggctatcatatccgctttttccctgccgccatcacgtgggagcaggaaccggaaacatggaaggtatggtggcgccagcgcacccgatgggcgcgcggcaatcaatatgtcgtgctcaaatttttggcgcagttttttaagctgaaacgaaaacggattatctttgatttgttttattttttctttacgtacttcctgtttttctttggcgtgatcatgtcaaatgcgatttttgtagtgaatttgttttatgatttgcatttgtcggttggatttttagcaatgattctctggattttggcgtttttcttatttatgacagaggtcatgattacgttgagcattgaaaaaacagaaatgaacaagcaaaacttttttatcgtatttctcatgtacttcacatactcgcaggcatggattgtgcttgttatctactctttaatcgtggaaatcaagcaccgtttattcaagcaagaggtcaaatggtacaagacagaacgatacaatcaacataaaagcgggtgacctttttgaaacaaataatgatttttctcacaagcttcatgctgctggcgatgactggacaaacggctcttgccaaagacgtacaggtcagcggttcgctcctcgggaaaagcagccaagaacaagccaaacagcagatgctgacaagcgagctgattacactgtatggatcaaaagacagcgcagagctgacgtatcagatcccggcaggcgcctcttcgggcaatcagcaattggtaatcgaatacgaggcatcaaatcttttaatttctccatcatcgttaacggctgtcattgatgatgaaccggtcaagacgttaaagcttgatggtgattccaaacggaaaacagtgaagctgaatctgaataaaagccagtctgcgcaaggctatcacaacgtatcgctgaaattctacggcgtaatgaaagagggcgtgtgcgtcagacaggatacatcaggcaactggatcaaaatttatccggacagccggctgacacttgctgacagcagtgaagcgaagggaacgtcgctggaccattatccgtatcctttcgcccaatctggaaatacagcggaagaaacagccatcgtcattccggatcatccaagttcagcagaaatagaagctgctgttaaaacagaaggctatttgaaaacggtggacagcagtgtcagtattgcgtatgtcacggaatctgaactgaaaaaaatcgataagccgacgattgttatcggcgtggacaagcattggaacggcaaagtgaaaaaactgttgaaacaagctgggctacaggcaaaaggagaaaaccttctgcttgcggagcgggtgctgaaagcagagggcaaacagcagccggttctgtttgcgcaagcggcgtccgaggacgcgctcacaaaaaaaatcagcgtgatgacagatcagacatatacaggccagctcagcggcgatacactttcaatcagcaagcttcagcagactgaaaaaaaagaaagcgataagctgacccttgagaattttggagcgggtgatatcacaattggagccgacaaaacatcttcagcacattatttttatccggcttcggctgttttagatgaaaaccaatcggcgaagctgtcgcttaaactgaaaaagtctgaaacgattcaggcctcaacggctgaaaacgagtcagcctctcaggctgcagaactgaaagtgatgatcaacggccagccgcactcggtccggcttgatgaattaggaaaagaagataaaaacggattctatcatgtcacagtgaaagtggaccctaagctgctgcaaaaaaaccgctacattgatattcagttcgtcacgaccggtttaaaggaaaacaacccttgtaacaccactgatgaagaaaagtgggtttttatcgataaaaacagtacattatcatacgccatcaaaggcatgtccccgtcagcggattttgaagagtggccgctaccttacgccggaaaccaggatcaaacaacgttaatcgtgcttcctgacaccgtaagccaatcgaagctagaggagctttctctcgtaacggaatcctttggcagcgaagcacagcattcatatacggtaaagaaatcatctgacgttacagcaaatgatgcgaaaggacgaaacctcattttcataggagggatcaatcaattttctcttctgaaggagaaatcatcagatctgcttgtgccgcaggaaaagaacggatcgtttgatgtatctggtttcgagatgctgaatgagacgacaaaacaagtggtatttacccaagcatcggtttgggattcacgctatacaatggctgtctttgcaccgttaaaaggagatggcgcggctgtcacaaaagagatcatcagttatctgaacagcaacgatgagtcggcaaccgtccttaatgaaacaaacagccagcaggtgtttacaaaccaccagcagctcaaatcggaaacaaacagttccgatgcagaacaactaacacaggatcatagccagaaatggatgtatattggtgtgctggcactcattatggtgattgcggcagtgttcatttggattgccgtaagacgcagaaaaagaaagacagatacagaataaaacagaggcgattttagcctctgtttttttatttttggtaagtaaattccatttgtggaacctgtcattttatttttttctctcagccaataagcctctttacaacgtgcgggaacgggagtatgatctcttttagaaaacaaatcgcttaatctgaaatcagagcgggggacccaatagaacggctttttgccgttggggtgaatcctttttaggtagggctaactctcatatgcccgaatccgtcagctaacctcgtaagcgttcgtgagaggagatgaatgaaacctgtgttcgatgttatggcacaggggcatccgtttgcctctgtgttttttgttgttcatttttgaatgcaaatcgcatacagagacatcatagcagaaaggactatcaacaacatgtgagagcaagacactgatgttttattgttttaattgaaaaatgagaaattaaaaggggaagacatcgatgtatcattcaatcaaacgttttttgattgggaaaccactaaaatcccaagcagctggagagcaaaaactgacgaaattaaaagccttggctatgctttcctcagatgcgctgtcatctgtcgcatatgggacagaacaaattctaatcattttggcaacaatcagtgctgccgcattttggtactccattccgattgcggttggcgttctcatattactgctcgcactgattctttcatacaggcaaattatttacgcttatccgcagggcggcggggcgtatgtcgtttctaaagaaaatctcggtgaaaaaccgggattgattgcgggcggttcattgcttgttgattatattttaacagtagcggtaagtatttccgcaggcacggacgccatcacgtcagcctttcctgcattgcatgattatcatgtgccgatcgctatttttctcgtgttagtgattatgattttgaacctgcgcggtctttcggaatcggcatccattcttgcctacccggtttatctgtttgtggtggcgcttttggttctcattgcagtcgggttgtttaaacttatgacaggacaaatagaccagccagcccatcatacaccgctgggcacacctgtagccggcattacgctgtttttgctgcttaaggctttttcctccggatgctcagcgttgaccggggttgaggccatttctaacgcgattcctgcattcaaaaacccgcctgcgcgaaacgcggcaagaacgcttgcgatgatggggattttgctggcgattctgttctccggcatcacggtgctcgcgtacgggtatggtacggcgccgaagcctgatgaaacagtggtttcacaaattgcgtccgaaaccttcggacggaatgtgttctactatgtcatccaaggtgtcacatcgcttattttggttcttgcggcaaatacgggattttcagccttcccgcagcttgccttcaacctggcgagagaccagtatatgccgcgaatgtttacagtcaggggcgaccgcttaggcttctcaaatgggattatctttttaggctttgcctccattgttctcattatcttattcggaggacagacggagcacttaatcccgttatatgctgtgggcgtatttattccatttacgctttcacaaaccggcatgtgcatgaaatggatcaagcaaaaaccaaaaggctggatcggaaaaatgctgatcaactcctgcggtgctctgatatcgtttatggttctatccattctgtttgtgacgaagtttaatgtcgtatggcctgtgttaatctttatgcctatcgtcgttttgctgttttttgcgattaaaaatcactatacagcggttggtgaacagcttcgcatcgtagacaaagagccggaagaaatcaaaggcaccgttgtgattgtgcctgtggccggtgtcaccaccgtcgtgcaaaaatcgattcactatgcgaaatcactgtccgatcaagtgatcgccgttcacgtgtcatttgacagagaacaggaaaagaaattcgaaaaacgctgggaagagcttaataacggcgtgcgtctcgttacgcttcactcctcgtacagaagccttgtccatccgtttgataagtttttggaaacagttgaggcaaaagcgaagaaggagcagttttccgttatggtgctgtttccgcaatttataacgaaaaaacgctggcacaccatccttcacaaccaatcggccttcctcctcagagtccggctgttctggaaaaaggacataatggttgccacactgccgtatcattttaaaaagtaaagctctaggaccaagggaatcaccttggtccttttttgcgggaaaaggaggtatggcggtgtatacacaaggtgcttttgtgatcgtattgaacgaaagtcagcaaattctgctggtgaaacgaaaagatgtccctctatgggatttgccgggcggcaaggttgatcccggggaatcggctgaggaagcggcagtgcgggaggtattggaagaaacgggatacaatgcagcgctttctgcgaaaataggtgtttaccaaaggccaaagtttcaagatgaacagcatctgtttttcggaagcataacaggcggacaagcagtggctgacggcacagagacagcgggattaaagtgggtttccccggggcgtttgccgctttttatggtgccgaatcgaaaaaggcagatcaatgatttcaagaacggcgctcaagatgtaaatgtcaccgttaaggatagagggttgctcgcggcgatcgacctgttgaaaagaagacttggcaagtgattcaggtctccgggttttaaagcctttctcctgtggtattgaaaaaaggaaaaaggaggatacgttatggcacataaaactgcaggacaagtaatgacagagctgcttgagcaatggggagttgatcatgtatacggcatccccggagacagtataaatgagtttattgaagaattaagacacgaaagaaatcaactgaagttcattcaaacccgccacgaagaggtagcggcactggcagccgcagctgaagcaaaactcaccggcaagatcggagtctgtctgtcaatcgcagggccgggagcggtgcacttattaaatggtttatatgatgcaaaagcggacggcgcccctgtgctggcgattgcaggacaggtttcttctggcgaagtcggacgggactatttccaggagattaagctggagcaaatgtttgaggacgtggctgtgttcaacagagaggtacatagcgcagaatcacttccggatctcttaaatcaggcgatcaggaccgcctacagcaaaaaaggcgttgcggtattgagcgtgtcagatgatttgtttgcggagaaaatcaaacgggagcccgtgtatacttcaccggtgtatattgaagggaaccttgaaccgaaaaaagaacagctcgtcacctgcgcccaatatattaataacgctaagaaaccgattatcctggcagggcagggaatgaaaaaggcgaaacgggagctcttagaatttgcggacaaagccgccgctccgatcgttgttacactcccggcaaaaggtgtcgttcccgataagcacccgcattttctcggcaacctcgggcagatcggaacaaagccggcttacgaggcaatggaggaatgtgatttattaatcatgctcggaacatcattcccgtaccgtgattatttgcctgatgacacgccggcaatccagctcgattcagacccggcaaaaatcggaaaacggtatccggtgacagcgggccttgtctgcgattcggctctcggtctgcgcgaattgacagagtatattgaacgcaaggaagacagaagattcctgaatgcctgcacagaacatatgcagcattggtggaacgaaattgaaaaagatgagacagaggcaacaacaccgcttaaacctcagcaggtcgtggcccgtcttcaggaagcggcagccgatgatgcggtgctctctgtagatgtcggcactgtgacagtctggatggcgcgtcatttcaaaatgaacgcgaatcaggatttcatcgtttccagctggcttgcgacaatgggctgcggcctgccgggagcgatcgccgcgagcttgtccgaaccggaacgccaggcgatcgccgtctgtggtgacgggggattttccatggtcatgcaggatcttccgaccgctgtcaaatataagctcccgatcacagtcgtcattttaaacaacgaaaatcttggcatgattgagtacgagcagcaggtcaaaggcaatatcgactatgtcacaaaacttcaaaatgtcgactatgccgcatttgcagaaagctgcggagcaaagggcatcaaagtgactaaagcggaagagcttgcgccggcattccatgaggcgctgcactctgaccaaccggtcgttgtggatgtcatgattggaaacgaaccgccgcttcctggcaaaatcacatacgggcaggcgaaaggttttagcaaatacatgctgaaaaacttcttcgaaaaccaaaaaattgaaatgccgtcactgaagaaaagtttgaaacggttattttannnnnnnnnnnnnnnnnnnnncccttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtccttgtatgtttattcttatcaaatcttacagaactcttctcattataagcttatttctcttttttcttcagcccgaagaagaaaggaaaagcagaaccgaccaagaaggtgccgaataaaaacatgccgccgataaacacgtggaaatttgtgtgtccggccgtaaacgccgtgattagggaaataatactgagcacgatcatggcaatgccgggcgcgactctcatttttcccttggatctatgggcagcaacagaacataaaatgccgataacgataggaacaatccacaaataaaacagaataaatactgacatcatcaaaactccgatttttcttctatcataacaaatttctgtcaaaaagggtatcaatgagcttttgcgaaaaaataaaaaccggctttagaagccggttttttatcgaaacgtatctacaattaaaaacacattcaaagcaacgatcaatacagcaatcagccaagacaccactgtgacccatttggcgttgatcagagatcccatgatccgtttattgcttgtaaacataataagcggaatgagggcaaaggcgatcccgaaggacagcacgacctggctcagtacgagagcggtcgtcggattaacacctgacgcgatgatcaagatcggcggaatgatcgtgataaaacgccgtacatacagcggaatgcggtagttgataaatccttgcataatcacgtcgcctgaaagtgtgccgacagacgaactggatagaccggcaacgagcagcccgatcccgaataaagccgcagacataggactgacaagatgtccgaattgctgaaatgcgacgtcgagatcctcaacaaacaggccgtttttgaagaataatgcggcagccacaatcagcatacttgcattaatagcccctgcaatcagcatcgctattaaaatatcaataaattcaaacctaaagatttttttccgttctgcatcagttttgccaaccacccgccgctgtgtaagggcagagtgtaaataaatggcgtgcggcataacagttgcgccaagaatacccgctgcaagaagcacactgtcggtgccatgaaacgccgggacaaaaaggcccttcatcactgacacggcatcaggctttgcgaaaaaggtctgcagcgcaaaggcgatcacgaccacaaacagcataccggcaataccggcttcaagtgagcgataaccgcggcgctgaagctccaatatcgcgaaagaaccgatcgccgcaataatagacgcttcaagcatcggcatgccgaacagcaaatacagtcccagagccgctccgataaattccgccaggtcagttgcgataatgacaagctcgccctgaatccataatccgatcgagacaggcttcgggaattcttcacgggcaacctcaggcagatttttgcctgtcgcaataccgagtttggcggatagggattgaattaaaagggccatgatattagaaaataagatcacccataagagcatatatccgtatttagaacccgccgaaatattcgttgcgaagttgccgggatcaatataggcaatggctgctataaatgcagggccgagaaaagggagcagccctctgaatcctctgattttcccgtcaagcgcatcttggacggctttggaacggggagattgtgctgtgatgtccttgttcatcatgtctcacctgaattctgtttgtttttgccgtacaacaaagagtttccttaaggcaaattattttatctacatcatatgaccatcccggtttcttgtcaaccgaaaatgttcaaaatacacttctgaatttttccctgttatgtaacatgatatgtagggattcggaataaggtcccatataaaaagacatcgtttcagttcgaaacgatgccttctgtatctaatgagtctaggcttccttccgcagcccgcggaatataaggcccagcaagaatacgaagatggctgccccgatgatggccgggaaaatagcaaagccggcgaggctcggtccccatgtgccaagaagtccgtgcccgatccaagcgccgatcagcccggcaatcatagagccgaaaattcctcccggcagccggtttcctacaatggcgctcccaattaatccgataacaatagcaacaactaatgaaaccaaaaagctaagcatcatgatcacctctcataaattatttaccaatcaataaccgctcctgatcatttcgaaacacttaaaagcatattcctttatgatcctgttttaatctttctctgcacactgccgtcagctaaatgaacaatgacctcagtgcctttatgcgccgcgatttcctttgcccgttcaatcgcttctttctttgtatccttgatttcagacacgcgtttggcgccctcggctttgactgcccagccttttttatgcttaataacatgctctgctttattcatgagctcggggccgctgccgctgcttggatcagcatcgcgttctgtctcatcatcatgcgtcaggaaatcatcaatttcatctgtagaggcgttttccgcccattccttcgctttgcttgtcgcaattggaatcgcgcgctcttcctcatagccttcatcaatcatcgcattcgcaatgtctatcgccttttttctcaccggcttctcaagattttttaatgaagcaggataatccttcatcgaccaaggcatgtctatcactccttttccttttataaaaatggtacccgcaggtgaaaaataaaaacgcatccgaaaaaatgaaggtatactatatagtagaaaaaacggaagggaagtgcgggttgggtgccaacagaacgaaaagaagacttacatcagcaattaaaagagatagagaaatgggaaaaagatcagcaaaaagtctggttttgggaaaagctcagccgtctcccgtttcagctgctggacaagctgacaccggaattcatccagaaaaagatcggcaagctcttggatgaggtcggcagctttgttcaaacaggcggacagtacctgacatctgaaaaacagattatcaggatgtttcaaaagaaactgccggaggagatctttgaatcgctggaggacatccggaaagcgcctcttcctgtcatggatgaaattgcggaaggaatgggcaaaaacagaaccaacgcagcaaccgttcaaggcgcgacaaccggtgtgggcggcgtgtttacgctggcggcagacattccggcagtgcttggcttatcactaaaaacattacaggatatcgcagtcgcatacggctatgacccaaaggagaaaaaagaacgcgtcttcattgtgaaatgcctgcagctgacgtcggctgatgttgtcggcaaaagatcgattttgcaggaattaaaacactacgatcaagaccgtacatataagaatgtcgcttctcaaatccaaggctggcgagaagtcgttttgggctatcgagacacgtttggctggaaaaaacttttccagatggtgccggttgccggaatggtttttggcgccgctgccaatcgctcaacattaaacgacattaccgagacaggcatgatgctgtacaaaaagaggcgcattcttgaacgactgaaagaaacagaacgagagatggaatagcagaaagcagacggacaccgcgatccgcctgctttttttagtggaaacatacccaatgtcttttgtttgtttaaaagaattgtgagcgggaatacaacaaccaacaccaattaaaggaggaattcaaaatggcagataataacaaaatgagcagagaagaagcaggtagaaaaggcggagaaacaacaagcaagaaccatgacaaagaattctatcaagagattggtcaaaaaggcggagaagccactagcaaaaaccatgacaaagaattctatcaggaaatcggcgaaaaaggcggagaagccactagcaagaatcatgacaaagagttctatcaagaaatcggtgaaaaaggcggagaagccactagcgaaaaccatgacaaagaattctatcaagaaatcggccgaaaaggcggagaggcaacaagcaaaaatcatgataaagaattctaccaagaaattggctcaaaaggcggaaacgcccgcaacaacgactaatcaaaagcataaaggaagacaacctgtaaataaaaaagcgatccggcacatcagctggatcgctttttttggaatcttctcaatttatgccgctattgcgatacaataagtgaaaaaggggttttcgctaatgtccaagatgcaaaacttgctcgccatcgcaaatgaagtcaaagaaaagcacgccaatttttcaatctcagaggtcaacgaccactgcgtgcgccttgcggtgtttacgggagaatatgactggcaccatcaccctgactcagacgaattgtttattgttcttgaaggggagctgctgatcgattttaaggacaaagaaaccgcggtgctcaaaacaaatgacagcctgctgatcccgaaaggcacggttcaccgcacacgctcttacgtcagaacggtaaatctctgtgtggagcataaacaagccgaaaccgtcatcatagaggagtagccatgctaatcaaaaagatgatatgtgaagtagacgctgcaaacgctgaagcatttgcaaaagcgcagtcacagtgggaagcgttatcgcatataagcggctttatcaaacaggccggcggctggcgaaaaacgatagacgagccgctcaccgcagaaatcatcagtgtatgggaaaacagagaagcctatgatcattttatggagaacgaacatgacagcatatacgaggaaaacgatcagaaggctgtaattctttcgatagaggtgacggtgtacgaagaggataaaccgttcgttcacgatctgttacataaccctgatatccggtacgaaccagactggacggttctgaaggcataatcaaagcccaaaacatcatgttttgggcttgtctctttactcgcgtcccggaagtgtattatgaacaaaaggcggtgctggttttaactccggtttttctccaaacgtttttgcttctttcacatattcaaaggcttctccgtccggcgctttttcattcagccagttttgctgggcgctttcttcgccttcagagaaattgataagctgatgtgagaactcttgtttttcgagcgctttcgggaatgtacccggcacaaccggaccttcctgtgcttctaattctttaatggcggcaagccattggttctggtgcatcgtgtcacgcgccagcaggaagctgagcatatctttgacgcctttgtcatccgtcatttcaaacaggcgtgcgacctgcagacggccctgagattccgcattcaggttggcgcggaagtctgccagcaggtttccgcttgctacgatataaccgccgctccaaggtacgcctgtactgctttcaggcatggcgccaagtcctgatacaatcgcatggtgagggttcatgccgcctaggatggagccgatgaccggatcttcagcagctttttcctgctgatcaagaggtgcatcctcaagaagtctggcaatcattgttgcgatcatttcaacatgcccgagctcctcggttgccgtatccatcagcaagtccttgtatttttcatttcctcttgtgttccagccttgaaataagtactgcatggcaactgaaatttctccgaattgcccgcctaaaatttcttgcatttttttagcgaataatggatctggacgatctggtttagcaggatgctgcagcatttttgtgtgcttaaacatgtacccatctcctttttcgtttatctctttttatatttccgatcgatagaaagataaacgaaaaacagcgtatcgagatgggaactatgaatcttttcgcagctccaacagttcccggatcagctcccggccaaagatgggctcatactgccggtaaacagggtcaagacgcttcatccattcttgtttctctttatctgacagctcataaatatgtatagcagaattctttttgatttcttccagctgctccttgttcatttgttcggcatacgtttcattccactccgtcgtctccttcatcgcttcagtcaaaatgcgtcttgtttctggtgtttgcgccttccagaagtgttcatcagtcatgacagcgtagccgagataaccgtggctgcttattgtcaaatagtcctgaacattataaaattttttagaatagatgtttgaaattgtattttcttcgccatcgactacattattttctaacagctgaaaggtagaattgaaggattcctgatgaggtgttgcgccaagcagcttgaactgatcctcaatcacatcgctttgcataatgcgcagatcctgcccttttaaatcatccggtgttttgaccggcccttgatttgttgtgatttgcttaaagccgttcgtccaataggccagtccttttaattggtttttctttagagaatcaaacagctgtgtgccgatgcttccgttcagcccttttttgacggcgttgtaatctgtaaatgcatacggcagatcaagcactccccattcaggcgagagcatgccgagcttcgatgtggagggggcgataaattgaacatcgccgttttgcaatgcttcaatttcttcaatgtccgagtacaggcttccattcggaaatacttctatttttatttttccgcctgatttttcgttcaccagatcagcgaatttattggcggccagcccttttggcgtattttcagcaaccacgtggctgaatttaaacacgatttgatcctgcaggccttcctggtcgtcatcataaacaatctttttattgccggtatgatcatggaatccgataaataaagcggttgcaattccagcgatcatcagtgcgagacatgcaagcaaactcttcatgaaaagccctcccctatgttaaggataatgggggcaatgacattcgtaaagacctgaaaggagaagctgatgaccaaaaagaagctctcaatccgttggaaaatcacgatcttatcctatatactcgtcattttctcctttttgatcggcggcattgtgctcatcggcaacattcagcatacagaggagcgggagctgaaaaagcggctgatgaatacggcccggacggtgtcagagatgacagaagtgaaagaagccttggcgcgaaaaaaacaaacagaagcggttcgccatgcggttgaagaaatcaggatgattaatgaagcagactatattgtcgtcatggatatgaatcacatccgatatacgcatcctgtcagcacaagcattggcaagaaatcagaaggtgcagacgaggaggcagcttttgcggagcacatttatttctctgaagcaaagggcgagctcggcacggcggttcgcgctttttatccggttaaggatcaagacctgaaccaaataggcgtggtgcttgtcggaaaaacgctgccggggatcgctgacatcctgcttcatttaaagcgtgatatcgccttcatcgttgtgctgacactcggcttcggccttgctggttcctttttgctggcccgccatatcaaaaaacaaatgtttcagcttgaaccccatgagattgtccgaatgtatgaagaacggacagcgacgtttcactcgatgaatgaaggggtgattgccattgacaatcgtctcatcattacgattttcaatgaaaaagcgaaacagatctttgaagtgcagggggatctcatcggcaaggtgatttgggaggttctcaaggattcgcgcctgcccgaaatcgtggagcggaacaaagcggtttataatgaagaaattcgtgtcagcggaaaagtcatcatgagcagcagaattccgatcgtcatgaagaagaaagtgatcggcgccgttgcgatttttcaggacagaacggaagcggccaagatggcagaggaattgactggtgtcagaaactttgtggaggcgctccgtgtccaaaaccatgagcatatgaataagctgcacacgatcgccggcctcatccagctggggaaatctgaaaaagccttgcagcttgcattccaggcgtcaactgagcaggaaaatgtgactgaatttctgcaccgctcgattcaaaatgacgctgcggcaggccttctattaagtaaaatcagaaggggaagagagctcggcgttgctgttcatatagatgaaaacagcagtcttcagcaatttcccgagcatgttgatcagcatgatattgtcgtgcttttggggaatctgattgaaaatgccttcggctcatttgaaaccgttcaatctgaagataaacgaattgacattagtatcgaacaaacggatgatatccttgctattttaatagaagataacggctgcggaattgaaccggcacatatgcctcgcctttatgacaaaggttttacggtcaataaaactggcggcacaggctatggcctgtatttagtgaaacaaatcatagacaaaggatcgggcacgatagaagttgattcacatgcggggcaggggacatctttttctatcgtttttccaatgaagggggaggaagcacagcatggctcgtaaagaatggaaggttctgctcattgaagacgatccgatggttcaagaggtcaataaggatttcattacaactgttaaaggcgttactgtctgtgcaacggcaggaaacggagaggaaggcatgaagctgattaaagaagaacagccggatctcgtcattctcgatgtgtacatgccgaaaaaagacggcatcaagaccttgcaggagatcagaaagcaaaagcttgaagtggatgtcattgtcgtctccgctgcaaaagacaaggaaacgatctcactcatgctgcaaaacggggcggttgactatatcttaaagccgtttaagcttgagcgaatgagacaggcactcgaaaagtacaagcaatataaacaaaaaatcgaagcgaatgatacgctgtcccaggaacagctcgatgcgatcctgaatattccgcagcaggccgtacaggatctgccgaaagggttgaatcacttcacgatgaatgaagtcactgcttttttgaaacagcaaaccgcatccctttctgctgaagaggtcgccaaggcgctcggcatcgccagagtgacagccagacgatatcttgattacttagaaaaaaccgggatcatcaaattggacgttcaatacggcggagtcggccggccggtcaaccgctacgtgttaaaaggataaacctgagaccaaaaagaccaaaatgtccgttatgatcataaacttccccagacgttatgaaaacgctatcattctagtaagaaagacacaaaaggcgaataggacagggggatgaaggatatgaaactgtttaaaaatttaacagttcaggtcataaccgcggtcatcatcggggtcattgtcgggctggtctggccggatgtcggcaaagaaatgaaaccgcttggcgatacatttatcaacgctgttaaaatggtgatcgcaccaattattttcttcacaatcgttctcgggattgcaaaaatgggcgatatgaagaaggttggaaaagtagggggaaaagcgtttatctatttcgaggttgtcaccaccctcgcactcattatcggtttatttgtcgtcaatattatgaagccgggtgcgggtcttgattacagcaagcttgaaaagggagatgtatcacaatacacgcaaaatggcggtcagggaatcgactggattgaatttgttacacacattgttccatccaatatggttgatgccttcgcaaaaggggacattttgcaggtcttattcttttctattcttttcggagtgggtcttgcggcattaggcgaaaaagggaaaagcgtcattgatttcttcgacaaggtttctcacgtttttttcaaaattatcggctacattatgcgtgccgcgccaatcggggcattcggggcgatggcgtatacaatcggacacttcgggctcgattccatcaaaccgctggcaagcttaatgatgtctgtttatattacgatgttcctgttcgtatttgttgctttaaatatcatctgcaagctttacggattcagcctgtggaattaccttcgcttcattaaggatgagcttctgatcgtgcttggcacaagctcttccgaatcggtgcttccgcgtatgatggataaaatggagcgctacggctgttccaaatccgttgtcgggctagttattccgacgggctattcgtttaacctcgacggcacatccatttatttatcaatggcgactgtctttttggcacaggtgtttggagtagacctcagcatcggccagcaaattacgattatcctcgttctgatgctgacatcgaagggagcggcaggtgtgacgggaagcggatttatcgtccttgcctcaacgctgtcagcgctgcaggtcattccgctggagggtcttgcactcctgctaggggttgaccgtttcatgagtgaaggaagagccattgtgaacctgatcggaaacggaatcgccacgatcattgttgctaaaagcgaaaatgaatttgatgaagaaaaaagcgtagaggctgttgaaggcatgaaaaaaatgaaaacagcagtctgaaaaaagaacggcccatccatgggccgtttttttaattgtttaagaattattaaggtaaggacagagacctcagcatttttttgttatataatttacaaatggatactatattgaatgaaggacgtttgtcctaacaggagtgtataaatggccgctttagttaaattttttcagcacccgggagtaaggcgtttctccatctttgtcgtgttaactggtgtgttatatctatttaagagcatgatcaacttaatattgcttaccttcattttcacatttctaatggatcgtttggagcttgtcgtgcggcagtttgtaagccagttcttccgcgtgagccagcgggttgtcattacgtttctttacatgttgctggctgtgctgctcacagtcgggggctttgtgttttatccggtcgtcgcggcgcagatccagcagctggtaaagcagattaaacatattgcgtatcatcctgacagcatccctttctttgatgagatcaccagtgtcttcggggatattaacatcagttcatatgtcaaagagggcttcaatgtagtgtatacgtatctggccgatatcagcacattcggcttgcaggtcgtgatggcgctcattctcagcatgtttttcttatttgagaaaaaacggctttctgaattcatggcgaaatttaaaacgagcaaactgagggtcttttatgaggagattgcttttttcggaagcaaatttgcaagaacgttcggcaaggtgctcgaggctcaatttatcattgcgctcgtcaactgtattctgacgtttatcgcgctttggattatgcattttccgcagctgtttgggctttcgattatggtgttcttccttggattgatccctgtagcaggcgtcgtcatttccctgattccgctcagcattatcgcctacagcactggcggtggaatgtatgtgctctacattgtccttgtcatattcgccattcatgcgatcgaaacctatttcttaaatccgaagctgatgtcggcgaaaacagagctgccaatttttttcaccttcacagtactcattttctctgaacacttcttcggcatttggggtttaattatcgggattccgatctttgtgtttctccttgatattctggatgtcaccaacaaggaagataggtctaaaggaccccgagagaatagcgataaaatgtagtttaaaatcgaataatgagtgtgcctcgatctgccggcctgcctgttcaaggcatggaattaagactcggaatcggagcttggcattgcttcgcacagtggtgaacacaacaggtgacaatgcctgtcatcattacagaaactgaaaagaacaaacagtcggagtaaacgctcatcatcggtttaaccaaacatttggaagcaacaaatgctataatacaaacagtgcctaatgttgggcactgtttattttttgtcgaaaaaggaggaaggctttatggctgagccgattttacatattgaaggcctcgataaaaagattgggtctaaacagattttaaaacagatcagcatggacgtcatggagggtgaaatcatcggccttctcggtccaaatggttccggaaaaacaacactcatccgtatcatcgtcgggctgctgaaacaaaacagcggaagcgtgacaattagcggattccagcatgatacagagtttgaaaaagcgatggaagcggttggagcgattgttgagaaccctgagttctatccgtacctgacaggctgggaaaacctcaagcactttgcgaatatgcacaaaaaaatagcggatgaacggcttgatgaagtggtggaacgtgtcgggctgacgtcagcgattcatgataaggtgaaaacctattcccttgggatgcgccagcgtctgggaatcgcccaggcaattcttcaccggccgaagcttcttattctagatgaaccaacaaacggcctcgatcctgcggggatgaaggattttcgcgatcatattaaagagctcgcagaaatggaaggaacagctgtcctgttcgccactcatttattgcgcgaggttgaagacttgtgcgaccgtgtcatcatcattcaaaaaggtgagatcaaagcggaagtcagcttacaaggaactgatcaaaccacagaaaaagcgattatagaagtgcagccgcaagaaaaagcgctcaattggctgacaggcaatcaatatcaagctgagagccaagacgggacaattgtagttgaggtggcaaaagaaaacataccggagctgaaccgatcacttgtcggacaagatctgaatgtgttttccattacgccttacacgcagtcactggaagacgaatttataaaagcgacaacagctcatcaagaggagggagaagagcttgtctaaattaatttggaatgaacatatgaaactttttaatcggaaggtcactttggtttctcttatcctgatggctgtctttcaattcttcatggcattgatcattaaacggattgtcatcagtgccggaacagatgaaaacttcatcggctatttatcgtatacaccgagcctgaacattttgctgcaggctttaacgatcgtaattgcagcaacaattgtttcgatggaatttgataaaaagacgatcaaatttttgctcattcgtccggttaaacgccaaaaggtcttttggtcaaaattaatcacagtcgtgatggtcagcttctatttgtatctggcatactacattctggcattattattcggtctcgtgttttttggcacatcggtgactgcggaatcaaagacattgctggtcaacaccttggcgctgatcgggtcaaactggcttgaagctgtaatgatgggattattcgggctgctttgttcttcgctgttccgcaacagcgcggtagcagttgttgtttcttttgtcgttttatacggagcgagtacacttgttcagctcatgaagttgtttgaaaacaagtggggcagctttttgctttttgcgaacactgactttacgcaatacagaagcggagagacagcgttgttttcaggcatgacgccattgttttcaattggaattctcatcatacatgccatattcttcatcgttgttggctggtggtgcttctgtaaacgggatgttcgggtctaaaggcaaggaatgacatttttgtgaaaaagctcacgtaaatcaatatcatttgatattttggtttatactaaaggtactgacggaggtgtctcgattgaggaactttattaccgctttaccgatcgtattgctgcttggattctcatttgtgtcattcatgtttcagtttgaacatcttgtttatttcaggctcgcgcttgggttgttttctctcgtgggactgtacatgatatataaaatgaagacgggcatccgctattttatcatctatctgtatgccagctggattgtgttggccgcagtgaccgcttttgaagagccgattttctcaagctttttctttggcggcctggtgatgacgatgggttacctgacatatatgctgatttatctcggcatgaaacaagaccgggatgcaaatcctgtgtaatcgcgctgttcccttggggaacggcgtgtttttctatactggacaaaaagattaacagttgcggaaaaatggcaggaaatctataatacatattaaatttatcggaattaaaacttggggggctgccggatgtcattatttatacaaaacgatcaacagcggcaatggatggagaaaatcggacggattgcggatgaatttcagcaaacagctgctgaagatgacgaacagggacgttttcctgcagagaaaatacaaaaactgcgtgatgctgggtatacagcattaacattgccggcatctcatggcggagggggcatttctgtttacgatatgctcctgtttcaagaacggcttgcacggggagatgctccgacggctcttagcatcggctggcatttgagcgtgatcggggagcttggagaaggcaacagctgggatgaagacgtatttgcatttgttgccaaggaagtccaaaacggagctgtcattaacagggcggcgactgaagcgaaaaccggaagcccgacaagaggagggcgtcccggtacacacgccgtcaaaaaggatggcaaatgggcagtgcacgggagaaaaacctttacgacgatgtcacaagctctggattattttttagtaacttcatggattgaggacaaacaaacaacaggcgtgtttctcattcataaagatgatcccggcttgtcgattgaagaaacgtgggatatgatggcgatgcgggcgactgggagccatgaccttgtactgaacgaagtaatgcttgatgagaataagctggtggaactgcttcaagggcctcgtggagctaagccgaatggctggctgcttcacattccggcgatttatcttggtgtggctcaagctgctcgtgactatgcagtgcaatttgcatctgagtattctccaaacagcttgaatggaccgatcaagaatgtcccggccgtacagcaaagaacaggcgaaatggagcttgaactgctcaatgccagacactttcttttccatatcgctcaattgtatgacgatccggagcggcgtccacacttgaccagcgagctcggtgcggcgaaacatatcgtcacaaacgctgcgctgtctgttgttgataaagcgatgagaattgtcggggccaaaagcctggaacgaaccaacccgcttcagcgctattatcgtgatgtgcgcgccggtcttcacaacccgccgatggatgacgccgtgatacacaagctggcggctgaagcgtttgagtcataaaaaaagagccttaccggctctttttatgtattgttttgctcttgcagatttttttgatgcttgcggtcaattctgtcataaataacgttcatcagctttggattgcccataatcgcctctttgttttcctggatcagctgttggtaagtttttactttacgcttcggcatgctccggcgccctcctgacatgtttgtattcactttctaactccgtcagcgacaattcatacagatgacgctttgactttttgtatataccattctgtattaacagatgaatgagctgtttttttctgatttctgcagactgaggtgtcattgtgtcaccaacctccaatcaaacgatattgataatcattatcaattaaattcagtatacaatgtccgcaatcgcctgtaaaggtgaaaacagtcctattctttcgccaatttacaaacattcaacaaatcgacaaaaagtttcccgggcaataatttgctgtcgaaatattccgcttcattgaacgcgtcctgctatttttcatgttttgaaccatactatgtaatagaatggaggctggtattcaatggagcggacagaaaatctgaaaaagggagaaaaaggggcgctcctcaatatttttgcatatgtcatccttgctgttgtaaagctagttatcgggattctatatcattctgaagcgctgagagcagacgggttaaataatggaacagatattgttgcgtcagtagcggtgctgataggattgcggatttctcaaagaccggcagacagcgatcatccatacggccattatcgggctgaaacaatttcgtctcttgttgcgtcttttattatgatggcagtcggcattgaagtgttaatcggcggaggaaaagcgattgcgggcggcacaacggaaacgccaaatcttatcgcggcatggacggcgttaggcagtgctgtgtttatgtatggcatctatttatataacaaaaggctggcagcatccattaaaagctctgccctgatggcagcggcaaaggacagcaggtcagacgcttttgtaagcgccggcgcgtttatcggtgttttttcgtcccagctgaagctgccgtggattgatccggtaacggcttttatcatcggcatcatcatttgcaaaacagcgtgggatatctttaaagacgcttcacattccttaacagacggcttccatttaaaagaccttgagccttacaaacagaccgtcggcaggatcgaaaatgtgcatcgcctaaaggatgtgaaagcgaggtatttaggcagtacagttcatatcgagatggtgattacggttgatccgaagcttacagtagaagaaggccatggagtggcggatgaagtagaagacaaaataaaacatgaacacgatgtcactcatgttcatgttcatgtagagcctgacgacataaaataaggctgtttaacgaattagcttatatgttcagataaaaattcagtcacttcttcaggcgttttggcattggcgctgtgaaggtgagctgttttttcaccgttcttgaaaataagcaggctgggaatgcccattacttggtatttttcagccaggtcaggaagctcgtccttattcagctcataccagtcgttttggttgtattcttccaaaatatcgccgatgaacatattcatgcgtgtgcagtctgggcaccaatcagcataaaactttacaatgatttctttatcagattgaatcagttcattaaattgttcgtttgttgtgatttttttcatatgtcacatctccttttcaatgccattttaatataaaataaaaaggaattacatacaaatgcattcaacatcagcatgcccaaaaataattagatcattttccggtgaaaatgataagatagtaaagatgaattgtagtggggggagtatccattgaaaacaagtctaggattagtgtacggaggaaagtcggcagaacataatgtttccctgcagacagctctggctgtaatcaaagcgctaaatactgagaagtttgatatacatccgatttatataacagaaaaaggcgaatgggttagaggcgcccgtttaactgaacctgtttcaaacgtgaaaatgcttcaatttgagcaaggaggcagtgctttttctccagctgccctgaaccaggagatgtttccgcaggaagcgtcacagcaaaatgaagccatcgacgtcgtattcccgctcctccacggaccgaacggagaagacggtacgatccagggaatgctcgagctgttgaacattccttatgtcggcaacggagtgcttgcttcctcagctggcatggataaagttgtcatgaaacatttatttgcgcaggctggccttgctcaggctaaatacgcagctttccttaagaaagactggactcgttctccgaaagaaagctgtgaggaggttgaacaggaattaggctacccttgcttcgtaaaaccggcgaacctcggctcaagtgtcggaatcagcaaatgccgaaaccgtgaagaactgcaaaaagcgtttgagcttgctttccaatatgaccgcaaagtcgtcgttgaagaaggaattaatggccgcgagatcgaaatcggcgttcttggaaatgatgatcctaaatgctctgttgtgggagaaatcgcaccgaagacagatttctacgattacaaagcgaaatatgaggatggagatactgatctgatgattccggcgattgtgaccgatgaggaatacgctacaatcagtgatatggcgatcaaagcgtttaaagcgatcgacggttcaggactcgtcagagcggactttttcctgacagctgacggcgaagttctgatcaatgaagtcaacacaatgcctggctttacacctttcagcatgttcccgctgctctggaaagaagccggagtggaatatgctgacctgattgaacagcttgtggagcttgcaaaagaacgccacgctgaaaaacaattgattaagcatacattctaatgaagaaggacactgccggtaaaagggcagtgttttttcccgtatatacaaaagaaagagagggaccttacttgattaagcgaacagtaaaaaacattgccgaaatggttaaaggcacactaacaaatccgcaatatgaacaaacagtcattcatggagtggcaaccgatacaagaaaactggaacaacatcagctcttcattccgctgaaaggggaacgttttgacggccactcttttgtggagcaggcttttgaagctggtgtagcggctgttctttgggatcggtcagtaccaaatccgcccgagaatcacgccgtcattttagtggacgatacccttaccgcacttcagcaacttgcaaaagcctatttgcaggagcttggcacgcgtgtcatcggagtaaccggaagcaatggcaaaacgacaacaaaagatatgattcacgccgtactggggacccagtaccgtgtccacaaaactggaggaaacttcaataatcatatcggtttgccgctgacagttttagcgatgcctgaaaatacggagatcgccgtattggagatgggaatgagcgccaaaggagaaattgacctcttgagccgcctggcaaacccggatgcggcagtgattacgaatatcggcgaatcgcatatgcaagacctcggctctagagagggcatcgcggaggcgaagcttgaaatcattaacgggcttaaagaagatggagtgctgatttatatcggggacgaaccgctccttcaaaatgcatacagctgccagacgaaaacgtacggtacgggaacgcataatgattatcagcttcaggatgtcagccagagtgaggaaggaacccattttacaatcaaagggatagaaaaaacgttttttattccgatactcggcaagcacaatgtgatgaacgccatggcagcgattgctgcaggggcgtattttggcatcgcgcctgaggatgcggcaaaaggactgagcggcctaaaggtaaccgggatgagacttgaactcatcaaaacagacagcggcctttcgataatcaatgacgcttataatgcgagcccgacttccatgaaagctgcaattcaattgacagaaagccttgaaggctacggcaaaaaaatgctcgtgctcggtgatatgcttgaactcggcgatcttgaagaaacgttccataaagagtgcggcgctgtgatcagccctgagaaaattgaccgcgtctttacgtacggaaaactgggagcttttatcgcggaaggcgccctgaaacactttgagaaagaccgcgtcagccattacactgagaaaaaagatctcctccaagctgtgaaggaaaacgcatcaaaaggcgatttgattttattcaaagcgtccagaggtatgaagcttgaagaaatcgttaaagatttaatagagagcccgctttcataagaaaatattttgcgaaaaaacgcatattgcatcataaaataacatgatatgcaaacactaatgtatgccggccgaaaattatgtatatctggccggctgcggctatgatacaatatatataggttatttcgcgatacgaacatattcgtccggacttttcatcgtgagccgaagttctccgctggattcttgggagcggatggagcagcagccggcatattcgagatgccgatctgcttctcatcttattgaaaaacaaatagtgtaatggtaagataaaacttaaagtaattcgggctttgtatacggatggatcctgtccttcttgtctaaagggcagttttataagtggtaaatcacgacattactgaaacagcaattagaaggagtttgaataatttgactataacgtttcaagattttaatttaagttctgatctcatgaaagcaattaatcgtatgggatttgaagaagcaacaccgattcaggcacaaacgataccgctcggactttcaaataaagacgtcattggacaagcgcaaacaggtacaggtaaaacagctgcgtttggtataccccttgttgaaaaaattaaccccgagtctcctaatattcaagcaatcgtaatcgcgccaacccgtgaattagccattcaagtatctgaagaattgtataaaatcggacaagataaacgtgcgaaggttcttcctatttacggcggacaggatattggacggcaaatccgggcgttaaagaagaatccgaatattattgtcggaacacctggacgtcttcttgaccacatcaatcgccgcaccattcgtttaaacaatgttaatactgttgtaatggatgaagcggatgaaatgctgaacatgggattcattgatgatattgaatctatcctttcaaacgtgccaagcgagcatcagacacttctgttctctgccacaatgcctgcgccgatcaaacgcattgcagagcgctttatgactgagccggaacacgtaaaagtaaaagcgaaagaaatgacggtttctaacattcagcagttctatttggaagtgcaagaacgcaaaaaattcgatacactgactcgccttcttgacattcagtctcctgagcttgcgatcgtattcggacgtacaaaacgccgtgtcgatgagctggctgaagccctgaaccttcgcggatatgcagctgaaggtattcacggtgacttaacgcaggcgaaacgtatggttgcgcttcgtaaatttaaagaaggcgcaatcgaagttctagtcgcaactgatgttgccgctcgcggacttgatatctcaggtgttacacacgtatacaacttcgacgtgcctcaagatcctgaaagctacgttcaccgtatcggaagaacgggccgtgcaggaaaaacaggtatggcgatgacgttcattacaccgcgtgagaaaagcatgcttcgcgcaattgaacaaacaacaaaacgcaaaatggaccgcatgaaggagcctacacttgatgaagcgttagaaggccagcagcaggttactgttgaacgtcttcgcacgacaatcagtgaaaacaacctgaacttctacatgacagcggcagctgagctgcttgaagatcatgatgcagtaacagtggttgcggcggctatcaaaatggctacaaaagagccagacgacacaccggttcgcttaacagacgaagcgccgatggtcagcaaacgctacaagaaccagcgctcttctaaacgcagagacggtcaaggcggcggctaccgcggcggaaaagggaaaagcaacaaccgttcttcctatgacaaaaagcgttcaaacgatcgccgttcttcaggtgacagacgccagaaaaaatcttactaatttgatcgattcagagcccaaaacatgatgttttgggcttttttatgttcgcgatttgttattcagcaaattttcagctgacggaagccatttttctctgtatgcttaagaatgaaacctttctgtaaaagagacgtataaataacgacgaaaaaaagggaggtaggtatttttgagagagcagccaaaaaaccaaatcagtccagacggattaaaggtttggcgacttcaagagatcatcatatccgctgtttgcttacttattgtcattgcagttgcagtgttaagctattattttcattggccgtactggatcagcggcgtgctcggcgcggtttggctgttgggatcgattgtgacggtctttatcattccgaaggtccgtcataaggtgtggcgatatgaagtccatgaacatgaaatagatattcagtcaggtatttttgtggtgacacgtgtgattgttccgatggtcagagttcagcacgtcgatacgtcacaagggccattattaaaaaaatacaacctggcaacggtgaaaatttccacggccgcgaccgttcattcgatccccgctttagagatggaggaagcggatcggctgagagactccatttcccgtctggcgagggtgactgatgatgatgtctgaaccgaaacgcctgcacccggcggcagtcattttgaatttatgccataccattattcaaacgataaaaaatatcattctgccattcttttttgtgtatattgtcaattcaaaccatactgtccgtttttacggagccattgcgctcggtgtgctattcatctggcttgtagcggcaagcattatcaaatggagaaggtttacctatcgaattgaagatgatgaatttagaatcgaagaaggcttatttgttacgaaaaagcgatacatatcgattgatcggattcaaacgatgaatacgagcgcgggccttgtccagcaaatctttaagcttgtgaagctgcaaattgaaacagcaggcggaggcaaggaggcagaagccgttctttctgctatttctgttgaagaagccgaacgcatcaaagaagctgtctttaagaaaaaagcgcaaagacgagaaaatgaacttgatgaagaacggcttgaagctgaagaggagttggttccggccgttgaggtgcaagagcactatcgcatgaacgcgaaagaattgctcatggccgcttctacctccggcggaatcggagtcattatctccgctgtatttgcacttatttcccagcttgatgaagtgctgccaatggattggttatttgataaattttccttccttcagcacgccagtattggtatttacgcggtactcatttttatcggtttatttatcgcctggattttcagcatcgcgggcatgatgtttagatacgcgaactttcaaatcataaaaaaagagcaggaactggtgatttcaaggggaattattgaaaaacatcaagtcacgattccgttgcgaaaaatacaagccattaaaatcaaagaaaatatcattcgccagcttttcggctttgtaacggtgtccatcgtcagcgcaggaggcggcgaccgggaaaaagaagaaggcgctttgaccattctctttccaatgattcataaaaaaaagcttacgcacatgctccgaacatttacgccggaatatacgctggaagaaaactgccgccgcctgccgcggcgcgcgttgaaacgctatttgttccgttctgtcattttttcactctttttgatcatcccgttatgtatcttctttcagccatggggctatctgtcagtgatcctgctgccgatagaattgctcttcggctatctcgcgtataaagaggctgcatggacgatcaacggggaccgtcttcagctgacgtctagatttataggcagaacaaccgccattgtactgaaaaaacgaatgcaggtctgcaagttcagccaatcctatttccaaaagaaaggccgcttgtataccatttctacttcggtgaaatcatcgagccatatggaagaattaacggtgagggatgtaggtgaagaggatgcagccttcattttaaagtggtactcatatgaaaaagcggacggttaataccgccgctcnnnnnnnnnnnnnnnnnnnnnnnnnnnnnnnnnnnnnnnnnnnnnnnngctcaatgcgaagtggatcaacggctaaattctcaggcgtcctgcctaaacgccgtcgtcatcacatcctgtgaatgtccgctcctatgctcgtccttcctagacttcaagggttttcaatcacgctgaaaagatgacaaaatcctaaaatgaaaaccattttaggattttgtcaacaatctgaggcggacggttaataccgccgctcttttttttgcacgcataaaaacgaaagaagaaacccgccgcatagtccaaacaaatgggccatcatgttaatattggagttgataaacgacatgagaatggcaaatgcgagcagtgtgatgatcattttggaatgctcctgcccaattaactcattgcgaaaaagaaccataaacaggtatacgccaaatagcccgaaaatggcgcctgaagccccgacatgcacgtaatcaagcggctctgtaacataagtgccgatattgccgatgatgccggagccggcgtatacaagaaggaaacgcgcttttcccagcatgcgttccaaagccggggcaaataaaaagatggacatggaattaaacagcagatgtgtgaaaccggcgtgcagcaaaatcggtgtgataagccgccaccattcaccgtttgcgacacctagattatagcctgtgacggtatccctccataacacgactgaatgggcaggaagtgaaaaaaacagccagagaacagcttgcaaagccaatataaaggtgacaacggggtaaagcctgataaatgtttgaaaattttcagtccgtataaacattccgagccccttttcttcattttggtatatctatagtaacacgtttatgagacaaaccatttaaatagtacgtacgcaaaggaggttatcatacatgatttacggcattgggctggacattaccgagcttaaacgcatcgcctctatggctgggcgccagaaaaggtttgccgagcggattttgacgcgaagcgagcttgaccaatactatgagctttcagagaaaagaaaaatcgaatttctcgcgggcagattcgcggcaaaagaagctttctcgaaagcatttggcaccggcattgggaggcagctcagctttcaggacattgaaattaggaaagaccaaaatggcaagccctatatcatttgcacgaaactgagccaagccgccgttcacgtatcgatcactcatacaaaagaatacgctgccgcgcaggttgtgattgaaaggttgtcaagctagtctgcatattagggaaaccccactcatatatttgatagtgcattaagggagacaagttgtttgaggcttttatggtacgcatctgttctgcctaaacgtgtaccgagcgtaccgttaaagtcaaacaagcgatttcttccttttacatcaattgagaaaaaggggttgaaaaaggtgagaaaaagctttgttttgcttttaacgggactgcttgctgttcttattctttctgcctgcgggcaaaaaacacagcaagatattgtggccgggttagatgaaaaggcgaaagaatacacctcgtacaaagcaaaagcgaaaatgaccatcgagacagggagtgagcctcaagtatacaatgtggaaatctggcacaaaaagccgtctctgtacagggtttatttagaaaatccgaaaaaggaccaaaaccaagtcattttacgaaatgaaaacggagtattcgttctcacgccgtctttaaataagagcttcagatttcaaagcgattggccgaacaacagcagccaggtttatctgtttgaatcgctcgtaaaggatgttcaaaacgattcggatgcagttttcacagcgaaagaaaagaaatacgtattcgaaacaaaaacaaattatcagcataacaaaatgctgcccacgcaagaaatcacatttaacaaaaaagatatgagcccgtcatctgtcaaagtgatggatactgaccggaaagtgatggtcaaagtagaattcagcagctttgaatttaataaacaatttgataaagaatcatttgacgaaaagaaaaatatgactctttctcaaatggatgtcgccacaagcgcgaagccttccgatacatttgcggtcaaaacgccgctggaactgccgcttggcgtcaagctgcttgaagaaaaagatatatctactgaagacgggaagcgcatcatcatgacctacggaggagaaaaatcatttacgttaattcaggaaaaagcccagattgccaaggcttcctcctccgttacgctgaacggcgaaccggtaaatctcggctacactatcggcgccctgtcggatgcatcattatcatggacatatgacggcgtagattaccttctctcttctaaagatctttctaaagaggaaatggtgacagtagcgaaaagcatgcggggacaatcatcgaaataaccgccaaaggccaaacatgatttggcctttttttcgttagacatcgtttccctttagcctttaattttagtatgatatgtaaatgatattgaataaaagctaggaagtgtcgtaatgagcacaaaacctttttacagagatacgtgggcggaaattgacttgtccgcgataaaggaaaatgtcagcaatatgaaaaaacatatcggtgaacatgtccacttgatggcagttgtgaaagcaaacgcctacggtcatggtgatgcagaaacagcaaaggctgctcttgacgcaggtgcttcatgcttggccgtggccattttggatgaagcgatttcactgcgcaaaaagggattgaaggcgcctatattggtgcttggcgcggttcccccggagtatgtggcaatcgctgctgagtatgacgtgaccttaacaggttattctgttgaatggcttcaggaggcagcccgccacacgaaaaaaggttctcttcattttcatctgaaggtcgatacggggatgaacagacttggtgtaaaaacagaggaagaagttcagaacgtgatggccattcttgaccgcaaccctcgtttaaagtgcaaaggggtatttacccattttgcgacagcggatgaaaaagaaagaggctatttcttaatgcagtttgagcgttttaaagagctgattgctccgctgccgttaaagaatctgatggtccactgcgcgaacagcgccgccggactccggctgaaaaaaggcttttttaatgcagtcagattcggcatcggcatgtatggccttcgcccgtctgctgacatttcggacgagataccgtttcagctgcgtccggcatttaccctgcattcgacgctgtcgcatgtcaaactgatcagaaaaggcgagagcgtcagctacggagccgagtacacagcagaaaaagacacatggatcgggacggtgcctgtaggctatgcggacggctggctccgaaaattgaaagggactgacatccttgtgaagggaaaacgcctgaaaattgccggccgaatttgcatggaccaatttatggtggagctggatcaggaatatccgccgggcacaaaagtcacattaataggccggcagggggatgaatatatttccatggatgagattgcaggaaggctcgaaaccattaactatgaggtggcctgtacaataagttcccgtgttccccgtatgtttttggaaaatgggagtataatggaagtaagaaatcctttattgcaggtaaatacaagcaattaacttacctaaatggagaattcataaaacagctttgcttgaagagtgaataatggtatcattatcactggatggataaaagagtcgtatccgtaagtttggtggaggtgtatgttttttgtctgaatccagcgcaagaaccgaaatgaaaatcagcttgcccgaaaacctagtagctgaattggatggtgtagcgatgcgggagaaacgaagcagaaacgaactgatatcacaagcagtgagagcgtatgtcagcgaacgaacaactcgtcacaaccgtgatttgatgagacgcggctatatggaaatggcgaaaatcaacctgaatatttcttctgaggctcactttgcggagtgcgaggctgaaacgacagttgagcgcttagtcagcggaggataatcatttgattgtgaaacgcggcgatgtttattttgctgatttatctcctgttgttggctcagagcaaggcggggtgcgcccggttttagtgatccaaaatgacatcggaaatcgcttcagcccaactgctattgttgcagccataacagcacaaatacagaaagcgaaattaccaacccacgtcgaaatcgatgcaaaacgctacggttttgaaagagattccgttattttgctggagcaaattcggacgattgacaagcaaaggttaacggataagattactcatctggatgatgaaatgatggataaggttgatgaagccttacaaatcagtttggcactcattgatttttagacatatttgcaggttgctcaaatagagcaactttttttgttttcaaaaaacataaacgatataatagtgaaataacgaaaaaatatgttgttttttattgggaggtaagcgaatttgatgtcgaaccagactgtataccagttcattgccgaaaatcaaaatgaactgctccaactgtggactgacacactaaaagaattaagcgagcaagaatcctatcagctgactgaccaagtgtatgaaaatatatctaaagaatatatcgacattctgttgctgtctgttaaggacgaaaatgctgctgaaagccaaatcagcgaactggcgcttcgagcggtccaaatcggactgtctatgaagtttttggctactgcgtttgctgaattctggaagcgtctctacacgaaaatgaatgataagagattgccagatcaagagagcacggaattaatctggcagattgaccgctttttcagcccgattaacacagaaatttttaatcaatactcaatctcatgggaaaaaacagtatctctgcaaaaaatcgcgctgcaagagctgtctgcgccgcttatcccggtgtttgaaaatatcactgtgatgcctcttgtcggaacaattgataccgaacgcgcgaaacgaattatggaaaaccttcttaatggcgtcgtcaaacaccgttcccaagtcgtgctgattgacattacaggtgtccctgtcgtcgatacgatggttgcccatcatattattcaggcatcagaagctgtaaggcttgtcggagcaaaatgcctgctggccggaatccgcccggaaattgctcaaaccatcgtcaatttggggattgatttatcccaagttataactaagaataccctgcaaaaaggaattcaaacagcattggaaatgacggatcgaaaaatcgtttcattgggggaataacattttgagacatccgaaaatcccgatcttgaaactgtataattgcttattagtgtccattcagtgggaacttgatgaccaaacagcattaacctttcaagaagacttattaaataaaatatacgaaacaggtgctaacggagtcgtcattgacctgacatctgtggatatgattgattcatttatcgcgaaagtgctgggcgacgtcattacaatgtctaagttaatgggggctaaagtcgtcttgaccggcattcagcctgctgtggcagtgacgctgattgaacttggaatcgcacttgaggaaatcgaaactgcgctcgacttagagcaggggcttgagacattgaagcgggaattgggggaatagcgaatgaacgaccaatcctgtgtaagaatcatgacagaatgggatattgtggccgccagacagctgggacgaaacgttgcgaaagaactgggtttcggcacggtagaccaggctagaattacaacggctatttcagaattagccaggaatatttatttatatgccggcaaagggcagattggaattgaacaggtcgcagacagaggaaaaaaaggcctgaaaattatagcggaagaccaagggccgggaattcctgatatccgaaaagtcatggaagacgggttttcaacgtctggaggacttggtgcgggacttcccggggtcaaaaggctgatggatgaattcagcttaaattccgtagcgggggaaggaacagagatacaagccatcaaatggcttcggtaggaggtaagaacgtggattttagggaggttattgagcagcggtatcatcagctgcttagtcgatatatagccgaattaacagaaacatctttatatcaagcccaaaaattcagccgaaaaacaatcgagcaccaaattcctccggaagaaatcatcagcattcacagaaaagtgctgaaggagctgtatccaagtctcccggaagatgtgtttcattcgctggattttttaatagaagtcatgattggttatggaatggcttatcaggagcatcaaacccttagagggatacagcaggaaatcaaatcagaaattgaaatcgcggcaaatgtccagcagacgctgctcggaactaaagttcctcaggaagaagcgctggatatcggcgccatcagtgttcctgctaaacagatgagcggtgattactaccactttgtcaaagacaaggaatccatcaatatcgcaatcgcggacgtgatcggaaaaggcattccagcggctttatgcatgtccatgattaaatacgcgatggactctttgccggaaacgggcatacacccttctcaagtgctgaaaaatttgaatcgtgttgttgaacaaaacgttgatgccagtatgtttattacgatgttttatgcgaattacaatatggacaagcatcaatttacatatgcttcagcgggacatgaaccgggattctattattctcaaaaagacaacacgttttacgatttagaggccaaaggactcgttctcggcatctcgcaggactatgactacaaacaattcgatcagcatctggaaaagggcgatatgattgttttattttctgacggcgtcacagaatgcagaacggaaaacggtttcttggagcgtcctgatctgcagaagctcattgaggaacatatgtgttcctccgcgcaggaaatggtcaaaaacatttatgacagcctcctcaaattgcaggattttcagcttcacgatgattttacgttaattgttttgcggagaaaggtttaacgtctgtcagaccagggtataaagcaactagtgatttgaaggaaaatttgaggtgatacgaatgaatataaatgttgatgtgaagcaaaacgagaatgatatacaagtaaacattgcaggagaaattgatgtatactcagccccggtgcttagagagaagctcgttcctctggcagaacaaggagctgacttaagaatttgcctgaaagatgtcagctacatggacagtaccggattgggcgtttttgtagggacctttaaaatggtgaaaaaacaaggcggttcgctgaaacttgaaaatctttctgaacggctgatccgactgtttgacattacaggcttgaaggacatcattgatatttctgcaaagtcagaaggtggagtgcaatgaagaataatgctgattacatcgaaatgaaagtgccggcccaacctgaatatgtgggaattataagactgacgctgtcaggggtcgcaagcagaatgggctatacgtacgatgaaattgaagacttgaaaatcgcagtcagtgaggcgtgcacaaatgcggttcagcacgcttacaaagaagataaaaatggggaagtgtcaatacgattcggtgtgtttgaagaccgtttagaggttattgtggcggatgaaggagacagctttgactttgatcaaaagcagcaggatttagggccgtacacaccttcgcacacagttgatcaattatcagaaggagggctcggtctatatttaatggaaacgctcatggatgaagtcagagtgcaaaaccactccggcgtcaccgtagcgatgacaaagtatttaaatggggagcgagttgatcatgacacaaccatcaaaaactacgaaactaactaaagatgaagtcgatcggctcataagcgattaccaaacaaggcaagatgaacaggcgcaggaaacgcttgtgcgggtgtatacaaatctggttgacatgcttgcgaaaaaatattcaaaaggcaaaagcttccacgaggatctccgccaggtcggcatgatcgggctgctaggcgcgattaagcgatacgatcctgttgtcggcaaatcgtttgaagcttttgcaattccgacaatcatcggtgaaattaaacgtttcctcagagataaaacatggagcgttcatgtgccgagacgaattaaagaactgggtccaagaatcaaaatggcggttgatcagctgaccactgaaacacaaagatcgccgaaagtcgaagagattgccgaattcctcgatgtttctgaagaagaggttcttgaaacgatggaaatgggcaaaagctatcaagccttatccgttgaccacagcattgaagcggattcggacggaagcaccgtcacgattcttgatatcgtcggatcacaggaggacggatatgagcgggtcaaccagcaattgatgctgcaaagcgtgcttcatgtcctttcagatcgtgaaaaacaaatcatagaccttacgtatattcaaaacaaaagccaaaaagaaactggggacattctcggtatatctcaaatgcacgtctcgcgcttgcaacgcaaagctgtgaagaagctcagagaggccttgattgaagatccctcgatggagttaatgtaatgatccaggttgaagaaaacgagcatattcaaactctagtatatcaactgaataaagaagggaaatcgatttgcggtgacagcttttttatgaaagctgatgataaggagttaatttgcgcggttgctgacggactgggaagtggatcacttgctaacgaatcctctgcagccatcaaagacttagtggaaaactatgcgaatgaagacgtagaaagcattatcgaacgctgtaatcaggcgatgaaaaacaaaagaggcgctacagcatctatcctgaaaatcaattttgagcaaaggcagtttacgtactgctctgtcggaaatgtacggtttattctgcattccccgtctggtgaaagcttttatcctctgccgatttcgggctatttatcaggcaagccgcaaaaatacaaaacgcacaccgccacctatgaaaagggttcaaagttcattatacatacagatggactcaacgtacctgatatccgctcccacttgaaaaaaggccaatcggtagaagaaatatcgaattcgctgaaaatgtatacgacatcgagaaaagatgacctgacctatattctcggacagctgtcctagagaataagaacaaaaagaagccggaatgccggcttctttttttatgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcttctttttttatgtgtttttttcggtttttgatacactagagaaagaacgacaaaattggaggctttggttacatggaaacgtcagcccttttaaaacagcaaattgcgaaagaaataggtttatcacaaaaacatgttgaaagtgttatccgtctgcttgaggacggcaacacagtcccgtttattgcccggtatcgaaaagagcagacgggttcaatggatgaggttcagattcaaacgatttctgaacgctggcaatacatacaaaacctgaatcagcgaaaagaagaggtcatcaggctgattgcagagcaggataaactgacagatgatctaaaacgtaaaatcgagcaatcggtgaagcttcaggaagtggaagacctttactgcccttataaacaaaaacgcaaaacaaaggcgacagtcgctaaaagcaaaggccttgagccgcttgccgactatatcctgacacttccccaagatgatcgtctggcagcaactgcagaccaatacatcagcgaagaaaaagaagtgttcacacgagaagaagcgattgaaggtgccaagcacattattgcagaacaaatctcagacgagccgaccttcagaaagtggattcgccaggaaaccttcaaaagaggaaccattaagtctgcagccggaaagtcggcagacaccgatgagaaaaatgtgtatgaaatgtattacgagtatgaagagccaattgcaaaagtcgttccgcatagggtgctggcaatgaaccgcggcgaaaaagaagacattttaaaggtgtcgatcgaaccgcctgcggatcacattaaggcgtatttagaaaaacaaatcatcaaaaatcgctcaacatccgtaaaagagattttgcaggagacaattgaagacagctataaaaggctgatccagccggcaatcgagcgtgaaatcaggaaagagctctcagaaaaagctgatgaacaggcgattcatattttctcagagaacttgagaaaacttcttttgcagccgccgatgaaaggcaaaaccgttctcggtgttgacccagcctttcgaaccggctgtaagctcgctgtgtcagatgagactggaaaagtcttgaaaattgatgtgatctatccgcatgcgccagtcaacaaaacaaaagaagcccatgaaaaagtgaaaaagattcttgagcagtatcaagtcgagatggtggcgatcggaaacggcacagcatccagagaaacagaacaattcatcgtcaatgtactcaaagacatgccgcgcaaaatttattatgtgatcgtcaatgaagcgggagcaagcgtctattcggcttcagagctggccagagaagaattccctgaccttaaggttgaagagcgcagtgctgtatctattgcgcgaagacttcaagacccgctcgcggagctcgttaagatcgatccgaagtctgttggtgtcggacagtatcagcatgacgtcagccaaaaacgcttaaatgaatctctgcggtttgtcgtcgaaacggtcgtaaaccaggtgggagtaaacgtcaacacagcctccgccgcgctgcttcagtatgtagcgggattatcgaagtctgtagcaggcaacgttgtcaaaaaacgtgaggaaatcggaaagttttcaaatcgaaaagaactgaaggacatcccaaggttaggtgcgaaaacctacgagcaatgtatcggtttcttaagagtgcaggaagggacagagcctttggatagaacaggcatccacccggaaagctataaagaaacaaaagcacttttgaaaaaactcggactttcaacagaacatatcggcacggcggaattgaaggacaaaatcaatcagctggcgctctctgaaacggcaaaagagctgggaatcggcgaaatcactctgaaagacatttgtgaacagctgacaaggccggaacgcgatccacgcgatgaggtgcctaagcctttgctgaaaacagacgtccttcagctggaagatttgaaagagggaatggaactgcagggcaccgtgcgcaatgtagtggacttcggagcgtttgttgatatcggagtcaaacaagacgggcttgtgcatatctcaaaattgagcaatcaattcgtcaagcatcctcttgatgtcgtatctgtcggcgatattgtgacagtttgggttgacggcgtagatgtacaaaaaggcagagtatcgctgtctatggtaaaataaaagcactgcttacgagcagtgttttttcctatagaaataccagcattgattcagcagtttaatttggtaattatctttttcaaggaacgctttttgcatctgctttttaagccaatttggcataggctcattcctcctcagcttttatcataagagggacggtgattaccatattgtatgcgaacggtgaattgtcccgttcaatgttttttaagtgaggtgcactatggataatatagagcttcaaaagctgacagaggatatttctaaaacgtattttaaaaagccgttccgccatcaggcgctttttaatgacaggcttaaaaccactggcggcaggtacctgttaacctcccataacattgaattgaacagaaaatatctgattgaacacggcagggaggagctgatcggcattatcaagcacgagctctgccattatcacctccaccttgaaggaaaagggtacaagcacagagacagagattttagaatgcttttgcagcaagtcaacgcgccgaggttctgtacaccccttaagaaaaaagcggaaaacaaaaaaaattatatgtatatctgtacggcctgcggccaacagtatataaagaagcgcgccatgaaccctgacagatacaggtgcggaaaatgccgcgggaaaataaaaagaattttttcgtgaaaaaggttgacgaatatggcaagcctatgttacattataaaagtcgttacgagagataaataaaaatatttacctcttgacactgtaaatcaaggctgatataataagtcttgtctcattattccacagtagctcagtggtagagctatcggctgttaaccgatcggtcgcaggttcgaatcctgcctgtggagccatattggagaagtactcaagtggctgaagaggcgcccctgctaagggtgtaggtcgcgtaagcggcgcgagggttcaaatccctccttctccgccataagatttcgatataagttctcaaccatcggcccgttggtcaagcggttaagacaccgccctttcacggcggtaacacgggttcgaatcccgtacgggtcattccatttcgttgggctatagccaagcggtaaggcaacggactttgactccgtcatgcgttggttcgaatccagctagcccagccatttttatttttgaaatctaatagtaagagccattagctcagttggtagagcatctgacttttaatcagagggtcgaaggttcgagtccttcatggctcaccatttgtctttttgcgggtgtggcggaattggcagacgcgctagacttaggatctagtgtcttacgacgtgggggttcgagtcccttcacccgcactttatttacaaagtgcacgcaaatcggttttactaggttaagagcctactaaaccagcacaaacacaatttaatgatcacgcggtcgtggcggaatggcagacgcgctaggttgagggcctagtgggtgaataacccgtggaggttcaagtcctctcggccgcatcaatgataccaagggttttgacacctttggtatttttttgtgtttatttttaaaattgtctactgccctaaaactgcctacttacctacagtaagccaactagatttgtccgccatttctttttgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttcataactaatgatatggatttactatgctgagggcccagtggggtgaataacccgtaaagttcaagtcctctcggccgcatctcaataataccaagggtttaaccacctttggtattatttttttgtgcggaaatacggctatgagagaagagttgctcaccaaatctcaccagttacttaaagtaatcatccaaacggtcggcagtttccttctgtttattaggaaaaagatgtccggaagtattcaaagaaacggaactatgtcctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatgttagagcagaatgatcaaattttttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatcacctctccatattatcaacaaacacgaaaaggattttaatgaaaataaaatgattagcgtatgtatctctaattctcaaaatgaatgaatagtcctttttaagatttacacacagttattctccaaggaaaaatgactcaatttttcgattttttatgtaaatcaaaaaagaatcatgttagagtaggtgtgctgaaaataattcaaaaaattattttgagatatgattaaagtaatattgccagagagtttcaattggacaaaattgtaagtgtttaatacactggggctgcaatcaaatatgcacctggaatcaattgctaaacgggggagtttatatgaacaacaagaaaaatatctttgatattgtaatgtacattattttcggtgtgttaagtctttttctagttgcaaaaactgattatggcactggagttttagtgtttgttgcaattttatacctcgctgttattgcttataaaattaagcaagtatttagtaattcagattcttaaggtgtaacacaaggaggatttcaattgagaaagaaaagagttattacttgtgttatggctgcatcattgactttaggctcacttttacctgcaggttacgcttctgcaaaggaggactctaagacaaccccttcttacgaagaactagctctacattacaaaatgaaaagtgaaaagatttcatcgaacgggaaattagttgaaattgagtatgtgagtggaaatgaaactcacaaagttcagatgaacggaaatgatcatactgtaaaagtcgatggcatagaacaaaaaggtttaaactttgagtatgatgaaaatgttgctaaaagaacaaattatgaaaacaataatttgaaatcaaatgaattcacaacacaggctgcaaaacctaaaaagggataccattatgtggggactttatctgggcatacaaaagcagctaaaaatgcgttatcagttacaatgtcattagtcggtattgtccctggcttgggatgggggagtaaggctgccactattttattctcttattgggcaaaagaacaaatccctgatgcgtattataaatatgatttatacgaaaaaggagcaatgactgatagttggtatcagtatgctacagttcaattttttgaagataaagctcataaaaagaaaatgggcaaaccttggacaagtactcctgcaaaagtagatttacctaatagctaattttaaaatcactttgtctttataaaggacaaagtgattttttgttatacagaagtaaaatccctcgtctgaggaatcttggaaaaaacttggttcaattttgatataacatgtttttttcttgctaatttagtttttctatgtatcgctacacattctaaataataagatattagccggacggttgatgccaagctcaaaagtttatatggaagtcaaagcataaaaaagggtgttacaacgtgtagtcttctttttattttgccaacgtaacaagtgtgaaagtaatgatttgtaggatcagttaagaaaggtttaagattagatattgaaaaattttatatattttcaataaaatactggtactataataaatgtatacagattgtatggagatgtaattaattaaaaaggagttttttaattgcgttggagtaaatggttcaatgttttttgtatagtagcattgggatcaatatatggttataaattatttactaaccaagaagtcagtactactcgtttaataatagcttctgtaattgtgttgtggaatattgttggactttttagcaaagaatcagtaaaacaagcacagcaagcaaattaaaagtcataaagttgggaaagaaggatgttacttatgtagtatccttctttattattccttgaaaaatgaaacaaattggagattacagcttatataatcaattgaagtcgttgattattttcatgaacaggagatttaatgctttctgatgaaatattatcgtatgaatgttgcaagaggaaacgttactcaaagattacagggatgtgatgaacactcctctttatcgcactcacctgaccccaaattgttggggaagggcaggtacggaagatagagtattttttcttcgtaacaaatcgaaaaggttggataataaaaaacttataatctaaggcggtatatagttgtgaaaaaggcgttatttcttatattagaccagtatgcagattgggaaggtgtttacttagcatctgcattaaatcaaagagaagattggtcggttcacactgtttctttagaccctattgtaagctcaataggtggttttaaaacatctgtcgattacataatagggttagaacctgcaaattttaatttgctagttatgattggcggggattcctggagtaatgacaataaaaaactattacattttgtaaaaactgcatttcaaaaaaacattccaatagcagcgatatgcggtgcagtggattttttggcgaagaatggtttgctgaataatcatagccatacaggtaattttgtttacttatggaaagattacgaacaatataaacccattagcagttatgtagagaaacaagcagtaagagataaaaatttggttactgctaatggaactgcccctattgaatttactaatttaattttagagatgattgattttgatactcctgagaacatagagaaaatgatgtatatgaatcgttatggtttttatcatttttgtgataaatatggaaatccatttgttgattaatttgctggaaatgattttcccgaatagggggctttgcgattgagttgaatttcctaataaagcaaagaaagatgatttgaggtcaagtttaacaaataatgccatcaatattaatttgcagttatttccgatacctgatataataaagaagaattatttttgttcggtgtaaaggatagtatgaagattgacttttcgtcttgatgatactttgggcaaggatagtatatactgtgtggttacacactaggaggcaacaaaaatggaacaaggtacagttaaatggtttaatgcagaaaaaggttttggctttatcgaacgcgaaaatggagacgatgtattcgtacacttttctgcaatccaaagtgacggattcaaatctttagacgaaggtcaaaaagtatcgtttgacgttgagcaaggtgctcgtggagctcaagctgctaacgttcaaaaagcttaatcttcaatcgtttatacaaacaggctctttatatagggcctgtttttttatgtctatatcatactcaataaaaaaccctactcaacgttcgagtagggagatgctacaaggtatagaaaaagatttaaaacttcaaaggtttgtttacagtataacatactggattgacaatatgcggaatgtatataaattatttaatgttttgttcaaatataactctttttttcactaacctgttcgttaatttaagtaagattaatgaattataaaaatggtttcatctagatgttataactcgcatatctcttttatgagaagaagataaacaattattattcaatgtggcagtggatataagaaattcttaaaaataatgaggagatcgattgtttttttctcctggaaataatcacttagagatacctaaaacaatgaaagccctacctctcttccatccttacggctccttgtccgtgccagtgtgaatcaggatactaaaaaaagtgactattttattgaattttttggtaaaacttcaatcttcgcagaagaaatgtaaataataaaaatggattagaatgtaggaataacaaaagaggtcgttaatgttctaaacataatttggagaagatttgcttttcatcataatattccgaaatattttttgggatcaatacactatctaaccgaaactttttatttgcttttcagtgattcctttaattacttccagttcactaatcaaaaattcatatgcattatccagcatttttttttcgcttgcattaagtgctttttctttcttcatacgcattaaatcacgtacaacttcagcgccttcttgtatttcacccgtttttattttgtccgtgtttattttatacctttgcttccatggcagtaacctatctgattctccatgctgaaaaatgtgcataatgtgttttaatgcaagtatatcggtaactggtcgtatattcgaactcaatattttacgcgttggaatcataactgtcatattactgattgacattcttatgacataatactgttgtttttcctctaagaattctttttcttctatggcttcaattatacctgctccgtgcattggataaacaatgttatcgccaatttgaaacatatcatccacctccatatatggtaaccttcttaagattaccatatatggaggtggaatatcaaacttttaataataacatgatcgaatttttgatgtcaataacttttttaaaaaaacagatcaagcaaaaacaatagggaacgtgtcggatttccaatcaaggaaaaggtcaattgatccgtgtnnnnnnnnnnnnnttggctcaatgacattacagaaatgatttgagtagaaataagaaggaaagatatttgtgaaatgtcagctaaaaataataaaagcacatgattaagttctaatttctttaccgatttgatatggataacggcccacttacttaatgatgcattttcacttatcttgcgaacagaaaaaggtttgttgataaacatttagccaccaaattggcattattatcagggaaattgacaaccttcaaatgggtattgaggtgagaagaaaaataaagaaaggagagattataaatgaagaccagaacataaagaagtgaaggggaaagaacaaggttaattgaaaagcaaactatataaaatagtttgcttttctttttgttatgaattcacttctttttctttctctttaatgactaataaaacaccgctcagaattaaaaacgaacctatccaaaatgtcccgcctatttgttctccaagcagaatccatccgagtaaggttccaaccagaggctgaaaaaagaaaaagaggcctccacttgaggcatttaataattgtaagcctcggttccacaataaaaaagcacaagcggttgaaacaattcccaaatacaaaagaccacctagaattttagggtcaagcagttgtgatgtaaaaatggtgctaggnnnnnnnnnnnnnnngggactccatttaataatagaataaactttataaattcatttttttgtatgataatggcgtcatattcatcgcttgttgaaatttacttatgaaataactggtactgttaaatccaacttgataagacacttctgtcacattggattcagggtgttgcagtaataataagcttttttgaattctataatccattacataacgtaatggcgtcttattcagcattcgtttaaaataacggcagcactcagaacggctcagttggccagcttttgcaatgtcctctaatgtgattttttcagcataatggagatggatccagtttaacatttgtttcattcgatgactttttatcatttcagattgatcgtactctaattgaaaaccattaacgaccatgtttttccacattaacgttaattgcatcgtaatgtcaatctcatagagcgatgtcttttgttgaatcaattgatttatttttttaacagcatctagaatattttttgcccactgttgatttccatccaaaaataaatagggcaaattggttgaaaacatatagggctgaacatagcttgaatacagttcctgagataaaacgaaatggggtgacacatttaaacaaatatacgtacaatccgagccttccttttcttctgccatgtgcaggcagccgctattgataaataatccatccccttcgtgaacctctattttttcttcatttatttgaaagagagctatcccttttagtatcaaaacaaattggatttcatcatgccaatgaagcggaatatagccatttatattttgattgatcgttgtcttgtaacaggcaactggtaattctaccgttcggtgctctgttaattcttttaaattttgatcgatcacaaaattcttcattctgacttctcacctcaatatatttatattttttcattcgatttgagtattttttatcctattttgcatttattataacactattattatatttattagtgaggagtcatgtatgaatacttccaatagaagaatgggattgttctatgttataacaggggcgacatgttggggaattggaggcacagtagccaaaaaactttttcaagaatatcaaatcgatgtcaattggcttgtaacgacacgcttgcttacggctggaatgttacttttaatgctgcaactgttcagaaaggaccggtctcaggttattgaggtttggaaacacaaagcgtcggctggccagctacttatttttggcctattgggaatgcttgctgtgcagtacacatatatggcatccattcaacatgggaatgctgccgttgctacattattgcaatatttatcccctgtaatcgtcattatctacacgcttttacgaaaacaaacggttcttaccaaacaagatatcattactgttgtacttgctttagtgggttgcttttttttgttaacaaatggttcaatgtctcaactttcagtgccggcagctgcagtagtatggggagttttatcaggattcgcggcagctttttatactttatatgccgttggtttattacataaatttgattctcttgtcgttgtaggttgggctatgattattggcggttttgcattgggttttatccatccgccatggcaactggattttcaacgattaactgctgaggcgtatgcatatattttatttgtgatattatttggaacaatgattgcgttctggttcttcataaaaagcttggaaagcctttctcccaaagaaacaagcctattaggcagtttagaacctctatccgctgttgtaacaactgtcgtttggttaaaagcgccatttggttcttttcaatggattggtgctatttgtattatagggataactttaatattggctttacataaagagccttctatgcagagtgaaaagtcgatattaaagattaggaatcatgcaaatcgggatatataggggcttttttgcttatatgaccggtccggcaatgaaaaacactggtggagtttgagccctctcggcaatatcaaaaataccaagggttttgacgcccttggtattttttcttcaagaaccttcaatttttcttctctgatcaaaaaacgtattacttttttgtaattggtatccaaatttcacttttaaaagatggtgatgttacatccttatgctcgttccacaaaatttctggaccttctatttgttcgtaatttgacgatggaaaccattcggaataaatacgtccccatacttcttgcagtgtatccggaaatggcccgattgattcgaatacagcccacgttgaggcaggaacttcaagccgtgagaaattatctggacactgtttcgttgtggctgcgccaatatagtgatcgagctctcctttttcctctgtccgaccttcagaaaaattggtggatgcactaatgagtcctgatggtgctacattagaaagctcttttagtttatttattgctttttcatctaaactttcccacatagatgcaatttccggattaattcctttgaaaataataggaactctttttttaatgccaacgatgcgaaatgcctctttttcttcaatacggtagttcatttcatttcctcctttaattgttagctggaaggtcattcgtggataagctttaagggaatggccattaagtctggcttttgatgggtttatgccatgtaaattttggaatgcccgtgcaaaagaatctggtgagttataaccgtactttattgcaatatcaatcacttttacattgctgtctttcagttcaaaagctgcaagagtaagacgtctgcgacgaatatattccgataatgaaatacctgcaaggaaggaaaacatccttttaaaatgatattcagagcagaaagcaagctttgctgcctcttgaaaatcaatatcattagtgaggttttcttcaatatactttaacgccctattcatacttttaagcaaatccatttatttggcctcctttaaccaaagaataacaggagtgaaatgtatttatccgacattctgtgcacagttttgcaggatgacttatatgaaataaagtaagtgattcacttgtatttgtacaggttttattgaagcatgctgttcataaaaaggcatcaataaaagaaagttataattgtcttataaacggcacattcatataattgagtgaaaaaggatgcgtatcatgcctatcaattcttttgaaaattatccgatgagctggaagccatcgattgataaagctgaaaagcctatttataaagcacttgcagggcaattggaacaggatattttaaacggagttttattacctggaacaaaacttcctccgcagcgagaattggctgattatttagatttaaatgtgagtacgatttccaaagcatttaaagtgtgtgagttaaaggggctgctgagtgcgactgtagggagcggcacatttgtatcgtatgatgcgttgtcgaatgcgtatttacttgaggatacaaagccgacacatttaattgaaatgggagcaatacttccagatcacgcttcatatgagcccttgttacaccaactgaaaaacatgattcaggaggaggattatgaaaaatggtttagctacggccgggcaggcgaaagcctttggcaaaaagatgcagctgtaaagctcatccaaagaggcggatttgaaacatccgttgatcacattttatttgcaaatggagggcaaaatgcgattgccgcgactttggcgagtctttgtaagcctggagaccgcatcggtgttgaccatcatacgtaccctggattaaaaactgttgcatcattgcttagtgtgcaaatcgtaccgataaaatcagaaaacgatgaaatgagtccggagtcacttgaatatgcgtgtaaaaatgaaaatattaaaggtttgtatttaatcccggattatcataatccgacgacttcctttatgtctgttgagaatcgaagaatggttgcagacattgcaaagaaatataatctgtttgttattgaggatgcatcgtaccatcttcttagcaaaaagccgcttccggcactcgcctcattcgcaccgcaacaggttattcatattgcaagtttatcaaaatcgttagcgccaggcctgcgtttggcttatgtagcagtgccgagacaatataaggagccaatatcgaaggcgctttataatttaaatataaccgtttccccgctattagctgaacttactgctcgcacgattgtatcaaatcaatttgaagtcttaattgagagtcatcgtgaacaaaccattcgcagaaatcaaatcgtaaaccgatatgttgcgggatatacatgtttaggtgttgaaacaggcatttttcgttggttgatgttacccggtaaaataactggcgctcaatttgaagagttggctgctcgacatggcgtgcaagtgtatgcggctgaacgctttgtagtaggcaatagttgtcctgaaagggctgtaagggtttctgtctgtgcaccaaaaacacttgaagagcttgaacaaggattaatgattctgagacgtttgctagacgatcttacctaatattgtttgccatacaattatgacattgtatggcttttttgtgcgtgttatgatgatccacatctagagggaggtttatacaaaattggcttttagaaaggaaggtcagatgatgttagacaaggacagcgtaaaagcaatagatgttcaaactgcttcattacaaagctacatcagttcaccagaaaaacaaaaatcgttatacaagcgtacactattcgttgtgagtatctcacaaatttttggcggtgcggggctggcggcaggagtgactgtcggtgcgcttattgcacagcaaatgcttggcactgatgcgtttgctggtcttccttctgctttatttactttagggtcagcaggatctgcattaattgttggaagactttctcaacgttatggccgtcgaacaggtctttcggctggctttatgattggcggacttggagcaataggcgttattatggcagcaatcataaatagtattttcttgttatttatttcgttgcttatttacggtgcaggtacagccactaatttacaggcccgttatgcaggtacagacttagcaaatcataagcagcgagcgactgctgttagtataaccatggtttttactacatttggcgcagtggcaggtccaagcttagtgaatgtgatgggggatttcgctctttctattggtgttccatcacttgctggccctttcattttagccgcagcagcatatatgttagcaggtgtggtccttttcattatgcttcgtccagatccattagttatagcaagaacaatagaagcggcaaatgaagagcctgatgataaaggatatttggcggcagctgagcatacagaaaacaaaaaaggcatcattgttggggcaacggttatggttcttacccaaatagtaatggtagctattatgacaatgacaccggttcatatgagacatcatggccatgacttgggtgcagtcggtcttgttattggttttcatataggtgctatgtatctcccttcactggttacaggtgttcttgtagataggttgggacgtaccgcaatggctatttcctctggaacaacgttgcttttggcaggtgtaatagcagcatttgctccgggagattctatggttcttctcgtcattgctctttctttactgggattagggtggaattttggtttgataagcgggactgcccttattgtagattcaactgatactgccacacgagctaaaacgcaggggacagtggatgttctgattgcgttgtcaggagctgctggcggagcattatctggaatgattgtggcaggttcaagttacctcgcattatcacttattggagggatgttgtccttattactcattccggtggtggtatggtctaggggccgctaaagggtaggattgtttaatttacattaatttgttatattgttagataaagtatattgcagcatctaatattctaacgaactatagttgctccattaaatctattataaagatttgaccaggattccttatagctgtgtcactcactgcatattctttaattgaatcacataaaatggttatcggatttgaaaaaggcaggattactcgctttaggtaaaggagtcataacgttgttaaaaaggttttctcttgtttttgttacactaatgatgtctatcgttgttgttttagcggctgctaaagagtcgcctggagatcatgtcatctcatttgatgaacctattatcttgatgatctcaattggaattgttgtatttttatttatccctccattagtcatgtccttttttggcaatttggttgtaagaataatatctggtgtataccaatgttttatcgttttcacttttctggggctcattccaattggatttcttattcccaatggctttttgacaattctagtttctattgcaggaactttagtcagtatagctagtgttgccgtaaccttatgcattggcaagaataaaaaagatatataataattgaattgttattttttcagattgtcagtgaaataataaaacaagatgagaaggctttgtgggccttcttttttttgttgttgcatcatccccactttaagcttaatctattgaataataagagaaggaacctatagaagaataaaataaataacgagatgtcaaaaataaaactggacttcattattatcaattcacgtaaatgtaaaaagcttggaaagaggggaattctttcatgacaaatagcagaacgaatccgaaggttgatgaatttttaagtaaagcgaaaaagtggaaggaagaatttgagaagttgagaaccatcattcttgactgtgagctgactgaagattttaagtggatgcatccttgttacacatacaataataaaaatgtcgttttaatacatgggtttaaagaatattgtgcgcttctgtttcacaaaggtgccctattacaggatgcccatggaattctcattcaacaaacggagaatgtacaggcggcgcgccagattcggtttacaactgttcaggaaataaatgagctagaaaacattttgaaagcctatattcacgaagccattgaagttgaaaaagccggtttgaaagtggatgttaacaaaaatattgaattgaacattcctgaagaacttaaaaataaattcgatgaaatccctgccttgaaaactgcttttgaagcattgaccccgggacggcaaagagcatacactctttatttttctcaagccaaacaatccaaaacccgagaatcgagagtcgaaaaatatgtgcaaaaaattctcgatggaaagggattaaaggattaggcacgccaaggttcaggctaaaggaatagcatcatagcgtagtaagatcctttctatagaagaaaaaaacaagcatagtaagatgcttgtttttttcttaggacaacattcacttactgctgaaatgcttcttttgattaacattgtatgccactagacagcgttataaaatattaatgcaacacctagaaatgaaatagctcaatggtactgctcatcacatttagaatgcctaggagaactaatagaaccggaagatttttagcaagttactacactccaaactttgtttttgtattaatataccttattaaccattgtttttagtcaggtgcagacaaacgaatactgattaatgaatcatcatgatatcaatgagccgtttgattttttcatcgtcgcctgtatcaacgtacactgtttttctgttttttatgatactctcagtcacttccctcatgacgcctttttctatatcatcagcggaatcccagcgtaaaggcacattatatacatgaatcgtgccatccccattgccatgataagtgactgatccatccactaaacgagaacctgccaactgggtcacatcttctggatagctggcacttgtatcatcattaggattaattggctcgccagccgcaatatgtcgaacatttaattcatctatctcttgattaggtccaagttgaagccaaactctggcatattcaattttttccgaagagtatgctgccaatacattgtcttctttgcttttctcttctgctgaagaggtctcatttgcagcttttgttgcggatttttctgattctgttattagctccgcttcatccttacgtattttggtactctcttcaggctcagtgtgtttttcgtcagattgtacagcagaagcctgatttgaaggttgaaatgcttcttcatccttactgcccgtacatccagcaagcaaaatcatgagcagcagggcagtattgcaataacatatctttctgcgtttcttcattctttcattcctctctattaattcaggtcagcttcatatataagtttatgtatctaaatattaccatggaatagataggatgatattgaaaactgtttaagaagaggaaacgatcttgaataacatcgcgaaaacttaagaattcttaagaagttttgcccctttttctnnnnnnnnnnnnnnnnnnnnnnnnnnnnnnnnnnnnnaaaaacgagatgccttatccgcctcgtgtcatggcagaaaaagtgggggatttattagagcggattttataatggcgtcaggtaaatgggtgttgacttatttgtctaagcgagagattcaagtctcctcgatcgcatacaaataccaagggttgctggcccttggtatttttatactttcatgcatttttgaagtttatgcttaaaggtctgccttactttgcaaatcgccgagctgctgcaacgcacatgataacggcgatattcactgctacgagtgcccagcccactttctcgtgcagaatcactgaggcaagcagcagcccaaaaaaaggctggagaagctggagctgcccaaccgccgcaattcctccttgggcaagacctcgataccagaacacaaagccgatcagcatgctgaataaggatacatatgcaagactgagcagtgcgggaacgccgatgtccgaccatgagtccggcgtaaaaaagaacgacaatggcaacataagaggaagcgacagaacgagtgcccatgagatcacctgccaattccccagacgccgtgaaagccttgccccttctgcataaccaagaccgcatacgacaatagaagccagcatgtacgcgtcgccaagcggggatgaacctcccccctgaatgagggcgaaacctgctactaacaagctgccggcagctgagaaaatccagaagacggggcgggggcgttcacccccgcgcagtacgccgaaggccgccgttgcgagtggaagaagtccaatgaagacaatggcgtgtgcggatgtgacatgctgaagcgctaaagctgtcagcaacgggaaaccaatgactacgccaaacgctaccactaataatgaaatgaggtctcttttggcaggatgctgctgccggaagatgagaaggagacatcccgccagtacaccagctatcgcagcacggcaaacggtgagaaataacggatcgaagtctgacacagccaaacgggtcgcaggcagcgagccgctgaaaatgagtacgcctataaaaccatttatccagccatttgttgttttgttcattataatcactccacatatctttcttgttcattgtctgtattttcttaacaaaaccagcagctaaggattacaatgactataaactggaattggccttttttaaacggccagttttcataaaaaaatgcataccagttaggagaacaacgcgcaaatggatatcacgccttttttgaatagaactctggatattccgctttatcagcagctttatcggtattttaaagaaaatatgcatcggggccgtattcaaaaaggaatgaagcttccttcaaaaagactcctggcgaatcagctttccatcagccaaacgactgtagaacgtgcctatgaacagctcgctgctgagggctatattgtgagcaagccaagaagcgggtggtttgctgattatcatgattctgattttgctaatgatagaatgccaagcacaacacccattcaacaagaagcagaagaaaataaacaatggattgattttcattatgggaatgtagattcttcttacttccctttttccgcatggcgaaaaagcatggtcaatagcttagaccaatatggacacgagctttatcggccaggacatgttttaggagagtttgagctgagaacactcattgcagagtacctgtatcaatctcggggtgttcattgcggccctgaacaagtgattataggtgccgggaaccctattctgctgcaaatcttgtgccaagtttttgagccgaatatttctatagggtatgaggatcctggttatccaagagcacgcaaaatttttgaagccaatcgcatgaatattgttccgataccagtcgatgaggaaggaatctgtatacagaaggtcaaagaacagcagccaaaccttgtatatgtcacaccttcccatcaatttacgctgggaaccataatgacaataaacagaagaattcagctgctcaaatgggcagccgaaaatcaatcctttatcatagaggatgattatgacggggaatttaggtacacaggacagccggttccttctctgcaagggcttgatcagcataaccgtgtcatttatatgggcactttttctaagtctcttttgccctcgctgcgtatcagctatatgattcttccttcacctcttttaaaaaaggggcatgacatcacgtcattatataagcagacagtgtcctgccacagtcagctaaccctagctgaatttataaaaaatggagagtggcaaaaacacatcaacagaatgagaaagctttaccgcaaaaaaagagccattgtattagaggcagtgcaaagggaattaggagagcatgtcagaattcgcggagaaaactctgggcttcgtatcttacttgacgtttatttgccatttggtgaaaaagagttaattgagaaggcgaaaaaacatggagtaaaaatttatcctgtttctctttcttatcaacatcatcctcctgcaaaaacggtctcactcgggtttgcaggggtttctgaatccgacataagagaaggcataaaaaaactgaaggctgcctggaagatatgagggagctttcagtttagcaaaacggccaagtgacgactaagtgttgagagctgttcaatattttttaagtatatgatgagtgcctgcagtccaggccacgatacgtctgtttagcgacaaacagaattttttatttgctcatcacagtgctaaaataaacaaaatagacaattgaaaaaatagaggtgtaagaatgaagttagatgagtttacaattggccaggtcttcaaaacgaaatcattaaaagtatcaaaagatgatattatgcggtttgcgggtgaatttgaccctcagtatatgcatgtagatgaagaaaaagcgaataaaggcagatttaatggaattatcgcttccggcatacaaacactggccatatcttttaaactttggattgaagaaggtttctatggagacgatattatagccggaacagagatgaatcatatgacattcataaaacctgtatatccggatgatgaattgtttacaattgttaaggttcttgataagcagccaaagagaaatgaattgggaatactcacagtattgctatctacttataatcaaaaagaagtaaaagtgtttgaaggtgagttatctgtattgatcaaacgataactcagaaagcccgcttttcgcgggctcgattgaagcagatgggtgaaagatgttagcgagtttcctttgaaaaataagaggttaaaacatcataaacaataggcaaagaagtaaatccctcatcttctagaaaatgacctccgtgctgaacttcatataacgcagcgtcaatttgttgtgccagatccttgctgaatgaaaaaggcacaatttggtcgtccttagaagcaatgacagcacggtgcttcgcggactcaatgattgtttgatgatcaaacgatccctgtgtaaattcatctaacatctttaaagtgggcaatgatttggcaaagccggaaacaaggatgattccgccaagctgttttcgtaattgaagatgttccaaaaatctcaaaatggcggggcaacctaagctgtgcgcaaccaaatacgtattttcatgtaaagtgtgctgatataaagagagtgtatccagccaatcctcaagtcttggctggagcggattaggcatgtttaaaatgtctgctttgaccccatctgcgagcaggcgttttttcagccaagggaaccaatgatttgttgaggaggctccgtagccatgaatgatatagacttgttttgtcattttttcctccacaagaagcattttcattcagtataaaattcctctcattgggaaacaagtacgcacttttttgtaagtagctttacatatgaggcattccttgtgccattccccacttacacatttcatctatgagggggtacaaagatcgccctctgtcagataacgaatactctactttcagtggggtttgagaaacctcataccgatgaataaggccgtcagtttgcaattccttaagctgtgcgcttaacattttatgggtgatgaagggcatagcccttttcagctcgccgtatctcatcgttttttcacaccctaactcatagagaattctcattttccatttgctccctataagagataaggtgtattcaaatggggcttgtttactgcggcacaggttattcattgtaatcaaacctccttttttaagtatcatatcagaataaattaggattttcggtgttgaagtttgagggcgattcacgatctgaagcggaaggggccgcttgctcaacaggcggcacggtacatgaatgttctaagtcaaagagggttaccttactgttaattactttatttaaaaaaacgcatgtttttagctgaaaatatctattatggtatatttaaatataacgaaatatttgagaaatgaggaatggtatgaatacaaccaaaaaacataagaaatttaaagcgaaaatgattttccaaatcatcatggttatcattggaggaatcatagcggcgtatggactagaaacagtgctcattccaaacagtgtatctgatggaggggtgacgggtcttagcatcgttggttcacagctattcaacttgccgctggggattttgattgctgtgatcaacattccatttgtctggttaggatataagcaaattgggaaaagctttgcattattatcaattatcggaatcgtatcgcttgccgcggggacaagctttttccaccacacacccgcaatcatagaaggagatacccttttaattaccgttgtcggcgggattatccttggatttggaatggggctggcgctgcgtaatggcggcgcattagatggtattgacatgcttgctgtgctgctatcccgaaaactgcccttcggaacgagcgatctcattctattcttaaacctatttgtgtttatttttgtttccacagtatttggcttacaaggggcattgctttcagtcattgcttactacattgcatccaaagtgattcatgttgtggaggaaggcttaagcggctctaaaacctttcaaattattacaacccaacctgaattaatggtagagacaatacgtgatcaattaggccgaagcgccacatataaagaagcttacgggggtttttcccacgagaaatttaaagaaatcacatgtgtcatcaaccgtttagaagaaaccaaactaaaggaaattattaatgatattgataaatccgcctttgtcaccgtatatgacgtagctgaagtgaagggcagcaattttagaagtcttaatcatcattaaaaaatagaatgacctttttaaccgtaactgacatgccgcgggtaaatgtaattaaaaacactttttgagggcttgtgggtgtcaccagtgaagggctgaatcataaaaataccaagggaatcaaaacccttggtattttttctggttattagattttatcttcagctttacgtgctgcttcgagcttatcaatcctgtctttatatttttctccccagtccttcatgtgcaggataacaggttctaatgttcttccaaactcagttaaagagtattcgacttttggagggacctgtttataaacctcgcggtgaatcacgccatcccgttccaattctcttaattgtagcgtgagcatacgctgggtaatttttgggtatagttttcgaaactcactaaacctctttttaccgtcaatgagatgataaagaagaatgcctttccacttacctccgatgatatctaatgttgtctccaccggacatccttcaaagtcatcagaagaataatcaatgccgagtttacgatttctcaagctgttcactcctaatagtatactttttgatactatatacattcaatgtgcgtactttttatattttaatatacatcatataatgatgtcacatcaaaggaatgaaaggaatggatcatatgaaaacactcgtactcgttgtacatccgaatatagaatcctctcgtatcaataagaagtggaaagaagccgttttaagtgaaccggatgtaactgtccatgatctttatgaaaaatatcgtgatcaaccaattgatgtggaatttgaacaacagcagctcctggcccatgaccgtatcgtttttcagtttccattatactggtacagcagccccccgcttttaaaacagtggtttgatgaagtgtttacgtttggctgggctcatggtcccggcggaaataaattgaaggggaaagagtgggtaactgccatgtccatcggttcacctgaacactcttatcaagccggcggatataacttgttttcgataagcgagctgacaaaaccgttccaagcatctgcccatttagtaggcatgacctatctgccttcctttgccgaatatcgcgccaatacaatcagtgaccaagaaattgccgaaagtgcgaatcggtatgtaaagcatattacaaatatagaattaaacccgaaggttcgcctgcaaaggtatttgaaacagctggagggtgtcgatttaacataaagattgtttttggaaaatcctgtactcaccaagcaggattttttcttgttcagcagagggattttaacatatagcaaaaaaagaagaagccaccaaaaataagctatttgcttggtcctgactgcttatttttggtgaaagacttatttctctgtgatgaaataaagcaaagcgatgaccggaaaagcgattccaatccataatgctgtactccatccgcctgaggcatatgcccatcctccaattgatgaccctatcgcaccgcctagaaagaagatcgccatgaataatccgtttaatcgactgcgaatttcaggcgccaacgaaaaaatagcacgttgactgagcacaaggtttgcagatacacccatatctaacagaatagctgcggccactagaactgttataccgacgggggagctgctctgaatcatgaggggcagtaataaagagacaacgacaacaacgagagcgattccagtggcaagcctggttaagcctcgatcagccaggcggccgcctattggtgcagcgactgcacccgcaatgcccaccaatgcgtagagtgctattgccttctgagaaaaatgaaaatcaggacccgacaataataaaggaacggtagtccagaacaagctgaaagctccaaatacaaacgcatgatagatggcacggcggcgtaagactggagtcgtgcgcagcagcttccacattgaaccgagtaaggcagtatagtttgtatttgctgttggttttctggcaggaagcacttttgataatacgatggccaggacaacacttaccacggcggacaaagcgaatattgcattccaaccccagatatcagcgactagactagatatcggacgggaaagcataataccgagtaataagccgctcatgacattgccaacaacccggccgcgtgcagcgtctgatgcaaggtatgatgcaaatggaacaagcacttgggctgcgattgatcccaatccgacgaaaaacgcagctgctaaaaacagtgttccatgcttcacaaatgctgttagtgtcaaagccgctgcgcttagaaggagcgatacaacaataagttttttgttttcgataatatctcctaaagggacaagaaataataagccggcaacgtatccgatttgggtgagtgtgacaatcaatccagcactgcttggagaaagtccaattgccttactaattaatccgaccaagggttgtgcatagtaaagattagcaacaatgataccgcatgcagttgcgagaagaagggttaaactgggtgaaatcctctgacctgcttgtttgtttccattagccataagaatgaactcctttttaagtggttttttgagtgtaatcatgacttctcaacacaagtgattttataaactgaacgttcagttttgttgattaataaaaataatatactaaacgttcagttttgtaaatggatttctgttttctttttttattcaggttaagtatactgaacgtatagtttatatttaggaaaggaatgattcatgtgcagagtaaacgagggcggccgcgtgatgaaggaacgcataaggcgattctctctgcagcctatgacctattgctggaaaaaggcttcgatgcggtgacagtcgataaaattgccgagcgtgcgaaagtgagtaaagcaacgatttataaatggtggtctaacaaggctgccgttatcatggacagctttctttcgaccgcgacggacaggctgcctgtgcctgatacagggtcgtcagtacaagatatagtaacccacgccacgaatttagctaggtttttgacaagccgggaaggaaccgttattaaggaattaataggtgcagggcagttggatgaaaaattggcagaagaatatcgcacgcgatttttccagcctcgccgcctccaagcgaaaggccttctagaaaagggaattcagaaaggtgaattgagagagaatcttgatattgaagtaagcatagatctcatttacggaccaattttctatcgtctgcttataacaggggatgaggtgaatgattcctatgtgcatgatttggtgatgaacgcgtttaagggagttcaagctacctctgctacagagagtatgtagctgataagaactgcaaaagctacggtttatatgacaaattggttctctctaatcgcacagtgaaagataagatttttgttgctgagcggaatcatcgagggaaaagttctcttatcggatgtcgaaaaagaagtcattcaatcgtgaatacattatattattacatttccttttcatcgattggaacaagggttctatacttcaatggaatatcgcaaagttggagtatttaaagaacaggggaaaatcgatggccattatatagatgtcatggcaatcgaaaaaatacttgcaatgtaaacaggcctctaaagagacctgttttttaatatccagaggatctgtctattttcatcttgggctctatgactactcccataactgaaatagtctaatatttataccggaagggattgtttatataaataaaagtttatataatgacgggggcgctaaggaaacgcggggagcgactcaggttttcgtttcaaagttttgatccttaagatatacggagcgctacatatggaaacgtaaagggaatgtataatcatttggcgtgtatataacgatttgcttatatattgatttgggaaggaggagctcatatgacgattgatgttgcggcgatgactcgttgtttgaaaacgcttagtgatcaaactaggcttatcatgatgagattatttcttgaaaaagaatattgtgtctgtcaattggttgatatgttcgaaatgagccagcccgccataagccagcatttgcggaaattaaaaaacgcaggttttgtgaatgaggacagaagaggccaatggcgttattattcaataaatggttcctgtcctgagtttgatacattgcaattgatcttacatcaaattgatcaggaggatgaattgttaaaccatatcaaacaaaagaaaactcaagcgtgttgccagtaaggaggcattagattgacatcaatgattttggcagtattcatctttttattaactctagtattggtcatatggcagccgaaaaatttatctatagggtggtcagcctgtggaggcgcagttttagctctgattgcaggtgttgtcaattttcatgatgtgttaactgtgacagggattgtttggaatgcgaccttggcttttgtggccatcatactgatatcgttaattcttgataatatcggtttctttgaatgggcagcgcttcatatggctaaggctgcaaaaggaaacggtgtgcggatgttcgtttatgtatctctattaggggctatcgtcgccgcgttatttgcaaatgacggtgcagctcttatattgacaccaatcgtattagcgatggtcagagcgttacattttaatgaaaaattagtttttccttttattattgccagcggatttattgcggataccacttcgcttcctttagtagtgagcaatttggtcaacattgtttcagcggactattttcatattacgtttattgattatgcatccagaatggttgtcccgtacttgttttcgctgctggcgagcatcattgtactttaccttttctttagaaaaagcataccaaaacgctatgatctgactgaggttaaaaaacctgttgaagcaattaaagatcaaaacatgttcagactgtcatggtatatcttagggctgctgttaattggatattttgcaagtgaatttttttctatccctgtatcagtggtagcgggcagcattgcgatcattttcttaatcgctgcgcaaaagagtccggccgtccatacaaagaaagtggtgaaagaggcgccatgggctatcgttttcttttcaattggcatgtacgttgttgtgtatggtgtccgaaatgccggattaacggatgtcctttcagatgtgattcaagccgcagctgatcaaggattgtttgctgggacaattggaatgggctttattgcggcgattctttcttccattatgaataacttgccgactgttatgattgacgcattggcgattgccggtacagatacacatgggatgatgagagaagcgcttatttatgcaaatgtgatcggttcagatttagggcctaaaataacaccgattggttccttggcgacattattatggcttcatgttctttcgcacaaaggtatgaagatttcctggggcacgtattttaaaacaggaattatcctcacgatacccactttattgatcacacttgtcggcctgtatatttggctgctgataatccattcttgtttctaaaaggacaaggtcactatatcaaggaaaacaatgcactggtaactcttgccgcagccaaatggctgaagggtgggggagaaaatatcttggggacaagtggaatgagtatagcgctgaaatcgaatgtcatggatgacatctgaaagctgtcaaagctatgaaagaagcagggattgatatttcaaatcaaacatcggataaatttgatgatccggcaaaagcacacggaacagaagaagtgtttccaaagggtccgtgatgaaattggtgaccgtttaaaacagtttgctgtaactggggaataaagaatcgatatattcagcgtttccttgggttatataatgcaatgtgttgttcaacaggtgtctgcgagctgagtgcagacacctgtttttgtttttatttgtctgagattcgtaacagggaagttatttagctggtgacagaggaaaattgatttgtgaacagaatcatgaaggagacggtgttttaaaggagttgtctgttttgcaggaattaacaaaagaaaaatacagtagcttaaaaacaatgtttgatgacaaatattgtcccacatttgtctattcaatattagaccaaaccattccgggagctgtttatgcagatgatcaaacctttcctaaatcgttttttataggaactgaatcaggcatttattttattgcgggagaccaagggaatcgggattttcatgatttcattgcaggatattatgaagaacaagtgaaatcatcaaaacgatttaccttgttttcttccagtgatacatgggatagcgtactgaaacccatactgaaagatgacttaaaccaaatgagaagagctgcattttcttatcaaccaaaatctttcaaaaagactttgcaactgccaaaggggcttgtattgaaaagaattgacgaagacatcatttcacatagcacagcgtttaacagcgcgtattatgaggagtattgggattctgtctcacagtttgcttcaaaaggttttggatttgccgtattacatggcaatcacgtagtaagtgagtgtacctctatatttttagggcataatcgagcggaaatggatatctacacacttgaggaatatagaggactggggttagcttattgcgtagcaaataggtttatagcgttttgtatggaaaatgggattgttcctagctgggattgtgatatctgcaacaattcgtccattgcattagcagctaaattgggttttaagccggtaactgaatactctatttacttttctagataatcttaagaaagaacctttaaaggagataccaaacgatgttggtatcttttttgttttagagttttttaatccttttaacagaaaaatgggtgatgaaaaacttattcattttatttacttttaggtaggtaaaacatactccgccaactgtaaccactccgcctagcagagagatcaatgtgggcatttcgccgatccagatccaagatatgatcaaggctaaagccggtgtaacataaagtgaaagggttgcttctgaggcaccgacgagtaaagtgacatatgcaagggcaaagtatggcacaactgttggcaataaacctaaataaacaatcgacaatgtagcgttcaaaggtgcgtctatcacctccgagcctaagccaggcaaaaaaataagcataggtactgttccgccccaaattgtaaatgtaacaaatggaataaaaccatatttttttatatagctaggttgaaaaacgaagtaaatactttcagaaaaagctgccagcaggataaccaaaaagcctttcaatgagtatgtattgtctcctgtcccaaatgcaatcaatgacacacccagtaaactgatgacagagccaagccatttcgtaaatccaaaatgctctttataaaacaggcgggatagcatggctgagaagatcggtgccgtagtaacgagtaagcttgcaactccggcattaactgttttttcaccgatgttcagcaaaatgtgatagagtgcaaatcctaaaaaccctaaaagaaaaatggcaggaatgtctttcaagtcgggtaggcgcatctgagtcaaaacagcaaaaagcaataatgccatagagccgattaacaaacgaaataaagcaaggtgttctggtgtgtacccttctagtcctgcgcgaattcccggaaaagcagatgcccataaaccaatcatgagactatgagatataattatttgaactgttttctttcgcattcctctcactcctctttacaaaaaccaaccagttatttaatgtgtttttatattaataaagatttggtgatatggcttcaaccagttaaacggattttgacccaaccaatttattttaaggagaccgattctatgagctttccagaagaaaaaaagatgaaaaagctccctaagtacagacaaatcgttcattttattaaagagaaaataggaaatggcgagtggccgattggaagcaagattccaagccagcgcacgcttgcaaaagattttcaggtaaatcggagcacagtgattacagccttagaggaattgatggccgatgggctaatagaaggcagaatggggaaaggcacagttgttatcaacaacacatggacactgatggctaagaattctgctcccgattgggatcaatatgtcacctctggcattcagatgccaagccggaaaatcgttcaagagatcaatcaatcagaatcaaatacagaccttatacagctcagtaaaggtgaactttcacctgagatttttcctttggctgttatgaaagagatgatggggaaggtatctcatcacatggaggcattcggttatgaagaaccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcttacctttattcattacacgtatttcaatcagctggtatgaagctgactggacttcctatggataatgaaggacttttgcctgaaaatgttcatttaacaagaggagagcggggaagggctatcttatatacaaatccatgttttcacaatccgactggtattcttatgtctaaaaagcggcgtgaagagatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggtttgaggattggatggatcgtcggaccggaaccggtgattgaacgtttatctgacattaaaatgcaaacagattacggatccagttctttatcccaaagagtagcggcagagtggtttacttccggccaataccagcagcatgtagaaaaggttaggcagcaattaaaggtgagaagagaattggccttgagtgctatagaaactcatttgaaagatgtggcgacatggaatatcccaaaaggagggttttttgtctggataaaaatattgccttccataacaatgaaattactttatactaaagccttatcaaaagggattctgctcaatctcggcagtatctatgctcaggaaaaagggaattatattcgtttatcatatgcttatgcatctcttgaagaccttcaaaaggggatttatgagttgggtttaatgattaaagaattggctagcaggtagtatttattcacaaggatatttcctaaaaaaagatcaagctaatgttggcttgatctgnnnnnnnnnnnnnnnnnnnnaatagaccaagtcttagcttggtcttaaaaagatcatgtctctgaacgaaaagtctttccgacttctcttcctaaaccaaagtagtgtctgaaattatagataagcgggctccatttggaagggttgatatggttttcgtccagaatgatactttcctcggcatgaaaatgtagtgcctgcgtctctacaattgcgaatgacgattcatattctggaagccgaatgtgtttcacttcggcttcgatttggatagggcattctttaattcgtgttggtgatactgtttttgattgtaaaggcgttaaccctgctgcctcgtatttttcttttttatatgtaaatccgagctgcttctttaaaggcggtatactcttttttccgctataagatgaaattctttcaatgttttcccataattccgggccaggcaagtttatgacacactctttgtgtctttccaaattgtcgatggcttttcctcccagtcctactccaaggattatataatgtccaagagcccaagaagaagacataggactaatattagtggttccatcctcattcaatgtggttagaagaaatgtcgaggtaccataatacatgatcttgggtttgatttccttaaatcgacgagtgtcttgttttttgatgtacaacgttttttcctccttgtcacgcttccatttatattgtaaaggattaacatttcaactatcatcgaaatatgaatgtaaggaggaaaatcatgaatcctaatattgcaaaaatctcttcgttgctatcagatccctcgcgttcttccattcttctcagtctgatggatggcaggatacaccctgcgggagagcttgcatatctcgctaacattaaacctcaaaccgccagttttcacctgaataaattgcttgaagcaaagctgattagcgtagagaagcatgggagacatcggtattacagattgtctgactcagatgctgcaaatgtgatcgaacaattgcttcatattgcgcctaaagcaaaagtcaaatctttaaaagagtcaaaagagaaaaaggacttgcatttcgcccgtacctgttatgatcatttggcaggttatgtgggcgtgcaaatggcacattcattagttgagcaggggatgttaaaaaaagttgatttaaactttgaggtgacttcagagggtgctttattcttttcaaagttaggcatcaatgaagagcaacaacggaataagaggagagcctttgcccgctgctgtttggattggagtgaacgacagcatcatattgcaggagcattaggaaacgccctattggtgcgcatgttagaagaagagtggatcgttcgtatgcctaaaacgagagcgattaggattacacaaagcgggaaaatcgcgtttgaaaagcacctaaacgtgaagatttaggatgttgaagcgaaggcacgatatccaggaggaggagtaagatttgttctaaccttactccttcttcttattttgaagcagctcgattccccattgcaatagagatgcggttccaactgtttatttgattaatgatcagaacaaggtcaacatattgtttctcatcataatgttcccgcacccgatgatatagctcatcaggaacccttttagatgggatgagcgtgatgtgttcagatagttcgagagccgctttctcttcaggtgagtaaaagtcacattcattccaagcatgtaaacagtaaattcgctgttcagtttctcccattttgcgggcatcggacgtatgcatatctatgcagaaggcacagccgttcatttgagagactctgattttgattagttctctcgtcgttcggttaattgaggattgtttcgtgtatttctccatatccatcatgattttcataccttcaggtgcaatctcatagtaggacactctttgactcataaggcaagactcctttccatagaatacctagattgtatcccggtattgatcattttaccaatgtgcggtttgaatgacagctgtttcaccgtcttttggaaagaagtttctttgaataaaaataagggtagccagcaatgatgagtggagctgctaatgcaagcagtatccatgagcctgattggctgtctctagtgactctaatgaatatataagtaccgatcagaaaatataataaagcacttagaaaccaatacatgttcaatcctctttttccttgctttttggttgcgcatttttgtctgtcatatggcttaatcgagcagggttctgattttttaataccttctcagtccggattccttttctctttaatgataaaattgtgagatcaatcgatttcaatgatgatcattccttcaatgaatagtaagttccttatgattttaaaggtaaatttgaaaagataaaacgtacatagaggcagaacgttcatgtacgtttgggcaatgatcacttattggaaactctaatgtttccctgcacctgatattgttgtgttccttctcttcctataaaatgattggatacatgtatgtttgcacgttgaaatatgggttcgattttcatgaatctctattcggtgaaacaggtaaaggaagtggataaggtttgcttataaggaatcctttcaaagataaatattactcacatgataggcgggcattaaacatgcttgcactcagagtgccgggcctggcttttattctcatgatctatatagcctctatcgtgctgcaatttgtttctgggggctggtccattttattgctttatgcgtttaccatattaatcgccatttttgctttgcttcattggcactcatatcgctgggttaagaaaagggtggttctgtattttgtgatacaaggtttgatcacctttacacttgctaatctcatgactggcttctttatacttgtgattatcggcctttatgcatttttaattggacaaatcataggaatggcagacagaagaaggacttttcttattctttatctattgctgctgctggtcataaattcggcgtttcaccttcataaaggtgaagttttgcattttattgttattgctggtccaatcatgattgtcatcatcacttatgccgcaacattttttgcccaagtcgatgaaaaaataaaagctcaattgactcttgaaaggctggagctggctcatcagcaggtagaacagctgacgctgcagaacgaaagacagcggatggcccgagacttacacgatacgcttgctcaaggtcttgtcagtttaaatatgcagctggatgcgattcatgttcatctcgccaaaggcaacacagagagagcgaaggaaatcatacaacaatcgatgaaaagagtgaaaagcacattagctgatgcacgttcagctattgacgatctccgcagcaaatcagaagaaatcggtgttttaaaagaaagaattacctcgctaatggatcattttatagagtcgacaggcatggcttgtttattagattacagattgcaccaggtgctggatgtgcgtacagctgaaaactgttattacatcattggagaatgcatgacgaatgcggcaaagcatgctgaggcgaaaacaatctggatatccatttgggatgatgaaaagggaaggctccatttaacagttaaggataacggcaagggatttgatgttgaaaaaggaaagaaaaagagaggacattatgggcttcttggcatacaagaacgcgtcagggcaataaatggccaattcaatatcaagagtgcaaaattgaaaggaacacaaattgagatcactgtaccaattcagggagagatgcaagatgaataaggttttaatcgttgatgaccatcttgtcgtgagggaaggtctgaagcttttaattgaaacgaatgatcaatacaccattataggagaggcggaaaatggaaaagtcgcagtccgtcttgcagatgaattagaaccggatatcattctgatggatttgtatatgccggagatgagcgggttagaggccattaaacaaataaaagaaaaacacgatacccccatcattattttgactacatataatgaagatcacttaatgatcgaagggattgaattaggagcgaaaggatatctgttaaaggatacgagttcagaaaccctttttcacacaatggatgcagccatcagaggaaatgtgctgttgcagcctgatatccttaaacgtctgcaagaaatccaatttgagcggatgaaaaagcagcgcaatgagacgcagctgacagaaaaggaagtcattgttctaaaagcaattgctaaaggtcttaaaagcaaagcgattgcctttgatttgggcgtctctgagcgaacagtaaagtccagattaacgtccatttacaataaattaggcgcgaattcaagaactgaggcagtaacgattgccatgcaaaaaggtattctgacaatagacaactaaactgcatatttgaaaattgcccaaacgtacatgcccgaatgtacgtttttttcatttcattgtcaactacaatgagaaagaatgtgatcaagcaatgtgttgaaaggagattatcatgtcaaaaatgttatatacattaggaggatgggttgctcgcaatcgcataaaagcaatttgtgcgtggatcgttgtgttagttgctgcgataggccttgcagtcaccttgaaaccaagtttttctgaggatatgtccatacctgacacaccttcggaaaaagcgatggatgtgattcagaaagaatttcctcatggtcctgataaagggagcatacgggttattttcggtgctggtgatggggagaaacttactgggaagccagcaaaaaaagcaatagaagatacgttcaaagaaatcagtaaagatgattctgttgactcgattgcaagtccttttgtgacagggacaatcgcgaaagatggcacagttgcctatgctgatatcaagtataaatcatcagcagatgatataaaggattactctatcaaacacttaaaagacagtttgaaaatggctgatgatgaaggattgcaaactgagctaagcggagatgtaccgggagccgagatggagataggcggtgtctctgaaattgtcggcattatcttggcttttgtcgttttagccattacattcggttctttattaatagctggtttgccgattttcactgcaatgattggtttaggtgtaagtattggactggttttgattgggacacaagtatttgatattgcttccgtcagtctttcattagccggaatgattggccttgctgttggtattgattatgctttatttatttttacgaaacaccgccagtttttaggcgaaggcatacaaaagaatgaatcaattgcgagagccgtgggaacagcgggaagcgcagtcgtttttgccggacttactgttatcgttgcactttgcggattaactgtcgttaacattccttttatgtctgcgatggggctgacagcagggcttagtgtactgatggctgttttggcttccatcacacttgtgcctgcggtcttatcgattgcagggaagcggatgattccgaaatcaaacaagaaaatagaaaaacaaagcactgaaacaaatgtctggggacgctttgtcaccaaaaatcctatcatgctaagtgtatgcagcattctgattttgatcgtcattagtatcccatctatgcatttggaactgggcttgcctgatgctgggatgaaagctaaggataatccggatcgccgggcatatgacttgcttgccgaaggctttggagaaggatttaatggccaattaacaatcgtagcggatgccacaaatgctacagaaaataaggcggaggctttcgcagatgcagtgaaagaaataaagggcttagaccatgtagcaagtgtcactcctgcaatgcctaataaagaagggaactttgccatcattacggtcgttccggaaacaggtccaaatgatgtcacaacgaaagatttggtacacgatgtacgcagtttatcagataaaaacggagtagatttgcttgttactggatcaactgcagtgaatattgacatttcagatcgcctgaatgatgcgataccggtgtttgctgtacttattgttggctttgcgtttgtattgctgaccatcgttttccgttcgctgcttgtgccgcttgttgctgttgcaggtttcatgttgacgatgacagccactcttggaatctgtgtatttgtcttgcaagacgggaatctcatcgactttttcaaaatacctgaaagagggccgatactcgcgttcctgccgattttatctattgggattctgttcgggttagccatggattatcaagtattccttgtcagcagaatgcgtgaagaatatgtaaaaacaaacaatccagtacaagccattcaggctggattaaaacacagtggtcctgttgttacagcagccggcttgattatgatcttcgtttttgcaggatttatctttgcaggcgaagcttctattaaagccaacggattagcactttcctttggtgtgctctttgatgcctttattgtaagaatgacactgattccaagtgtcatgaagctgatggggaatgcagcctggtatttgccgaaatggttagacaagatgattccgaacgtggatatagaagggcatcaactgacaaaggaaatacagccggaaatagatcatgaacaaaagaaacaaatcagtgtgtaatagaaaaagcagatctttaatgatctgcttttttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaaaaccgcaatccaaatgcatgaatcacaaaaatcacaacaggagggatcaagagggaaggcagcaaattcaatgttttgaacttcttgattccaagaatgcttagacctgaactgaggatgagtatgcctcccacaattgtgatttcattaataaggtctgtattgattgcgctctccattactttagcaaataaatagatggagccctgccaggcaaataatacaatggctgcagccgctattccaaaaccaaaagttgaagcgagcacaatggaggtgatcccatctaacatcccgtttgtcaggaggtatgtataatttccatgcaaagcggcttcaacagggcctaatattgacagcgaacctatacaaaataataagaccgcagtagataagccctctgctaaattgcttttagaaaatttgttcaccagcttgttgaatcgtaattctaaattgatgatctggcctagcaaacctccaatggctaaactcacaatgaatagaatggggtatttactatcagacaaatgctgtgtaatggcgttgatccccagcgcgactgcagcgaatcccattgcctgcatcaaaatatcctggtattcatctttaatgccttttttgaatatccccccgattatgcttcctgcaataatcatcactgtgttaaaaatcgttccaaacataagctttctcctccaaaaatcattcctgcataaaaaataaaccctctagttagtagagagtcaagggagataaaaaatattcatgagattatttgatgggcagcaggatttcagtcacataattatctaggttattcgtaatgccataatcaatgagtgtgatttcaattgagtcccctgctaccttataatgatgttctttcatatatgcctgtaattttttgtagtatggttcggcttctgggtgtgaccctttaaacctaatttgcagatattctcttgaaggaaagatgatttctgatgaagttttttcattttcatcttcaagaatcataaatatactggaatatttgtcaaactgttttgctttcacatttgctgcagaaatggataaaccgatcttgcctatgaatatatcttcgtttacattcaggtgggttctcaattcagctaacgaatgttcgatatcatggccgagaacatattcatgctgcaagtaagccacacgcattgcgggaagtttgatttttgaaatttgatgtaacggcatgttaacggcatcttctatatgtgtgatgcgtcgggagatctttcgttcgatgcgttccaattctttctttttgcgatcaatttcagcctgctggctttttagtaaatgaagaagagtgtttgtattttgagagttataaaaatcaagaagcttattgattggcaggcctagggccctcaaatacttgatggtatcaagccgctcaaactgttgggtagaataatacctatagttcgtttgctcatctttatattccggtttcaaaaggccgatttcatcataataccgaagagcagagattttcacattgaataactttgacacttctccaatcgaaaaaaattccttcattctaacaacctttctgtccctatgattgatatacacacattaatatagtacgctgagttctaaaggtaaagtttgcagcataaagaaaaaactccttctaaaaaggagcttttcattcttcgaaataaggatttacatggatgagcacttcttctacatctgaaaactgtcttttgatttcatttcgaatttcgcgggcgatgtcgtgtccctgcttaattgtcaaatcatgatccaaagataaacggacatcaagcaatttatagtggccatgttctcgcgcgcggattctatcaattcgttttacttgatcacattgaaaaataacagctttatattcctctatcagctcgggatcaacactcttttccatgagcacatcaacagacggcctgattaattccattgaaatcttaaaaatgaggtaagcaacgattgcactggcaatggcatcggcgtacaacagatagggccatccgcgggtgtttccgatgatagccaacaggacgccgataaaagcggcaagagaggcaacgatatcgcctttatgatcgtacgcaatcgctataatcgctttgctgttccatttttccccttgctttatagaataacgatataagatttccttagccacgtatgaaatcagagccgcaaacaatgcgctgtattggggaacgcttggccctttaacaaaggacagaatcgcttctatgaggatataaacggatacgatcactaagataattcctacaatcgcctcactaatgacttcagcttttccgtgaccaaaaggatggtcttgatcgggcggtttattggaaatgccgatcactgccaagactgcaatcgaagcaacgacatctgccgcggaatgtattccgtctgcaaacacggcttcactatcgcctgccagcccaaaaaagacctttcctgccattaagatcagattggcgatcaatgcaatcaaagcaacttttctgcttatttgttctctttcacttgccattttttcctcctataaaactgcacaaaaaaaataggagtgctctatatacgctctccgtatcctttcctgtgtaatcactttgcttatcataccaattcaatttcgagtgggtctacagcaacgttgtttcctgtttactaataaataaggtgacagaaaaaaagttggagctgtgctaaaaggtcatacagcaaacaaatgagttcttatgtaacaacagtgatgattcgccattaaaatgctgccgtcagtgaaaaatttccacctgattgttaaaaacctattgacatgagaagatctgtattttattattatctcatattcaagatattttaattcgagatatttgattgaaaagatcagcgatcaagcgcaactctaagtgttcaatcgttgtcagttcttttacacaatattcaatatgattttttataacataatatctcgaattcgagataaaagggagtgtagcgtaatggctgaatttactcatttagtcaatgaaagacgatctgcaagcaattttctttcaggtcatccaatcacaaaagaagatctcaatgagatgtttgaattggttgcattggcaccatcggcttttaatttgcagcatacaaaatatgtgacggttcttgaccaggacgtaaaggaaaagctgaagcaggccgcaaacggacaatataaagtggttagctcttctgcggttctcttggtattaggggataagcaggcatatcaacaagcggccgatatctatgaaggtttaaaggtattggggatattaaataagcaagagtatgaccacatggtgcaagacaccgtttcgttttatgaaaacaggggagaacaatttaagagagatgaggcgataaggaatgcttcactttctgcgatgatgtttatgctgagtgctaaggaaaaaggctgggatacctgcccgatgatcggctttgatgcggaagccgtaaaacggattttgaatatagacgaccaatttgaggttgtcatgatgattacgattggaaaagaaaaaacagagagcagaagaccacgcggctaccggaagcctgtgaatgagtttgttgagtatatataaaaggagcggataaaaatggctaaaaaaacgatgggaattcatcatattacagcgattgtcggtcaccctcaagagaacacagatttctacgcaggagtgcttgggcttcgtttggtcaagcaaactgtcaattttgatgacccaggtacgtatcatctttattttgggaatgaaggcgggaagccgggaacaatcattaccttctttccgtgggccggagcccgccaaggcgtcattggagacggtcaagttggtgtgacttcgtatgtcgtgccgaaaggggctatggcattttgggaaaagagactagaaaagttcaacgttccatacaccaaaatcgagcgctttggggaacaatatgtagaatttgatgatcctcatggactgcacttagaaatcgtggaaagagaagaaggagaggctaatacgtggactttcggagaagtaacgcccgatgttgccattaaaggttttgggggtgcaaccctattatcagcgcagcctgacaaaaccgctgaccttttagaaaacatcatggggctggagcgagtcggcaaagaaggggacttcgttcgttatcgttccgccggtgatatcggaaatgtgattgaccttaagttaacgcctattggccgcgggcaaatgggggccggaacggtgcatcacatcgcttggcgggctaacgatgatgaagatcagttagattggcaaagatatattgcttcccacggatatggtgtaactcctgttcgggatagaaactattttaatgccatttacttcagggaacatggggaaatcctgtttgaaatcgcaactgatcccccgggctttgcacatgatgaaacacaggatacaatgggcgaaaaactgatgctgcctgtgcaatatgaaccgcatcgcacacaaattgaacaagggctgctgccgtttgaagtaagagagttagattgatttgacacataaaaaataaagaaacatatattcaattgatgattgctggataccgtcagcaaagaattagataaaatcaaagatgaggagagatacaaatggaagatgcaggactgttgcttattcgtataatgattggtgtggtgtttttgttttatggcacacaaaaattattcggctggtttggcggatacgggattaaaggaaccggacaatggttcgagtcaattggggtgaaaccaggaaacgttgcggccgctctatcaggtcttggggagttagtaagcggaattctatttattttaggcgtattcctcccgcttggagctgctatcataacgatcattatgttaggtgccatcgtaaaagtccatggagcgaaaggttttgcgaatggcgcgggaggttttgaatataacctggtgctcattgcagtttccgtaggggttgcactcatcggttcaggagcttacgctttgcatttttaataagaaagtatgtaagaacagttgctgcttgtcagtaactgttcttttgtttttacattttccggcaagcttacaggtactctgcaaggcaaaaaagcggatatcataaataaaaatctgtatagtgaatgatacgtattgatgagcttggtcatgaaaaacagacctatttgaaggagtaaaggatgaaagagatgacagaattacattcattagattctatagaaaattttatcaaacagcacaaattcagttttatttatatatcaaggcctggctgtacagtatgtcacgcagttctgccccagctcagaatagtattggatcagtttccaaacatcaaattggcgcatatcaatgctgacgatgtagcagaggtcgccggcagattttcagttttcaccgttcctgtgcttcttttgttcattgatgggactgagtttctaagagaagcccgttttgttcattttgaacagcttgaacaaaagctgaaaagggtttatcgattatatgaagacgaataaagaaataaggcaaaaaaaagaactcaaatgagttcttttttttgcatcaatttattcttcactaggcgaagaagggttatcaacctgcccttgatcacttgtatcattatcacaacttgctgaaataataattgaatgagaaggagagtaatctcctaatgtgaaattgacaccgtaatttttgctgttcgcagtatggctgttttgcaagttttgtccgatatctgtattggcgttttgtgtcattccatttatcgtgagatttgagatgttgatttgagatcgcatgcttcaaaaactcctttcactcagaagtagccgtcatagaggacgctggcagtctatttacttctatgatattgcgtttttatatcattgcatcaacataatggtaaaaataatagcgagtgaatgagtctcttttgaagatgatcaacctatcagcagaaataaagccgcctgataaagaggcggcagatcgttatatgtcatctatgaatttgatgtatcgtttttcgtttgcctaaaggataagatggtcgtttttaatgatgagtaggagcctatagcagcgtagccataaaaccagcccataaatacgccagaaaagaggctgtgtcgatggcttatgaaaacagaaatgacaaggcctgttattaaggcaactgatggtacaaaagttttggggattttcaataatattttgaggatttgggttatcagtatgatgattggaacagctatcacagcatcccaaaagtttgtgtgaataattggaaaagccatacggcacctcatgaagtgttcatttcttatgtttacgctaaaagcttggaaagcagttcttggaccgcatttgtaacatgtagggcttgattggcggagcttgtttggcttaaagcattggattcaaaaaccaaacctgtattattccctccggaaccatctgtctctttagaaacagagaaagggctgatggagaatgcaaaaccgttattaaaaacgctgtttccggatatcgaatgaatatatactgggaatttcatcattcatctctcctctctgttatgactgtttatacaatatggtgtgtgagcagcaattgcttaaacaaaacggcaaaaacattcagcgagagacaaaaacctgcaaaattccacaagtgcctgttaatgcagtttttttgggatgttttttttattctttttgccaatttcatcaaaaatattctgattgctagacaaatgggcttgtccgtccttatttatgaaatccgggtgaatgagttttttcagatccctgactgttaagggtttggcgtcatcagttaattctattcctaattgcccgtttgcctctaatgtcgcaattttgacatcttgtatagccgtaacgccgtgaagccgtagctgcatttcaagctgatcaactgtaagtctcatcttctttaagttttcgatatgaagctgtccgttttcaataacaacttttgcttttccggtcaacatcttttcaatgaagttcgatctcatttggatccattctataagttattgtgaaaattgccgccgcaattaatgttttgaagaggctgtacttgatgattggctgcacgataatagttccgattgaaatcatgacaaccgtttgagttgaagtcatttgtgcgattgatttcattcctgaaactctcagcaaaatgactccggctacaatgagaacaagagattcccaagtgaaattcatgctaccacctgaccaatgatgaattagatttgtcatgggactggctttccttccggccaatcgcaatttaatatatccgaaaggcagttggttcattctgtcctgaaccgaacaatatttttggtatagatggatatattaagccaaacaatgaaagcagcaggagtcttttggccgaaacaatctgggaagcggggagcgccataacatgattgaacttgaagttgtcattagaacggttgccagctttggcttgctgttaatcgcagaacgaattttaggcaaacagacaatctctcaaatgacgatttttgattttattgcggcgatcacactaggggcgattgctgccggattagcttacaatacttcaataaaaccgcacaatattgccatttcgtttagtatttttgtgctaaccatttttctaatttcgtttctgtcgataaagaacaggaagctgaggaaattttttgccggagatccaacagtgctgattcaaaacgggaagatacttgaatcaaatatgaggaaaatgcgttacacacttgattatttaaatcagcaattacgggaaaaagaaatatttaatatcgaagaagttctttttgccattcttgaaacgaatggtcagctgactgtgttaagaaaaccgcaattccggcatgtgaccaaacaggatttaatgattgcggtaaaccaagaacacaggcttccgatagagcttattatggacggagaaatcattgagaataatttaaagcagaatcgtttgacggaatcctggcttttggaggaattgcgaaaaagagacataaaggtgaaagagaccgtgtacgcagtgctgctgggtaatggggatatttatgtggatcaatataaagaccatatatcagtccctatggataaggaatgaaggaaaatcaatcttaaagccccttattgaacgcaatggttccaacttgtcttgggtacgaaatgtgcagaagcccgtttaacagctgaatctgtaacaaatgagattcagtggcttcgggaagctgaatgattcgctcaatttctccgtaataccgttcacgcagcacttccatttcggctggaaaaacaggcgtgatcgttcctttgatcagcagctgggttttagatagtaaacggatcgttaattcttcctcatacacaccgggcatttccacaatgataaaattatcttcttcatcttgataaaagtcgtaaacgagcgtataggtgttggtattaaaaaattgttccggggctttatacttgagcacatttgtccaaaagtcattttgcttatattcatttgtaatctcaagccactttctcattttttcgagatccatctaggatcctccttaaatttggtttgaaatcggtgcagaagggtttccaatttggtcttgatcactgatatcagtatcgaggttcccagtatttaaaagagaagaagaaggcgaaaaatcccctagagaaaagtttgccccaaagtatttgctgttcgctgtatggctgttgtgtacggttggaccgacatcaatatttccgttttgtgtgacgccgttcaccttaatatttgcgatgttaatttggtatggcatagcgaaactccttttaatctaaaattggcggtactggaagcggaggagcattcatattggtagtatcagagtttccgagttctgtctgatcgttgacatcaggatcatttaagaagttttccatgattgattctgcaggtgatgtatcaccgaaagaggagttgatcccttgggatttattatttgcggtatggctgttatgcgcggcttcacctattgtaattgaaccattgcccgaaatgctgttgatctttaaataatataggttgattattgtagacggcatcccatcacacccttccatcattctgtacagtacattatgcgttgctgcacccaattgttccttgcatttgcgggcaaaactctatctggccctggagtgatgctcnnttatcagttgaatgaaaagccattgaatatagtaatcaatgaattgattcagttattcgaaatacatgagaccctttaataaaggaagctggcaaacaggatcagtttgaaatcattgacaatgaagctaatgccatgaaataatactcgtgagtaacattacttgcgagtattatttttgggggtggtcctcgttgaaaagcaaaaaaggacgtaaaggagaagaaagccggaaacggttactcaaagctgccgctaatgaattttcgattcggggattccatgacgcgaaggtaagtgaaattgtgaaaaaagctgggttcacgcagccttcattttacctgtactttcaaagcaaagaagccatctttgccgagttaataaccgattttcactctcgagtcagaaagctgacagagtcacttcttctggaaaacggattaaacacggaggatgtatcaaaacgggtactgctagctgtagagactgtttttcaatttttggctgaggacaaggatttaaccaagatcggcttttttctcaacccggaagcaaaacaaatgaaaaaagacttggcgatggttttgaaagagaacttagaagcagaacagcggcttggctattttcactctgaactggatatggaaactgtcgctgagtgtttggtcggcatgattgaacatttaaccgattcatttttgttaaccggaatcaaagatccggcaagcctcgcagcagaggttgtgaatcttttaatatacgggatgcttccgaaagggaatgacgtaagatgatatctactatgatgaaagtcagtttggcagtttttatgcttgcgggaggcatcataaaggtaagccgcgttccctttcaagttgagcattggcggcattatcaatatccattatggtttctgactgttaccggcattctcgaaatagccggggcacttgctatgacagcgggaatttggaatcggtatgcagcgattggagcaggtgttctgtttgtcgttctcatggcgggagccattcatgcgcatatgtttcgagcaagacaatcggtcatcatggcgataccagcgatgatttgtttgattgtttctatcatgatcatcatggggagttacacgtaagcttttcactaatgtttaagaacaagcccatttgcaggaaatctccttttcttatcgaataatagaaagtccaggaattaactgaatcattaaaatagagatccatttctgcattattcgtccggcatcagctgggctttttttataaaggaggaatacaggatggcattcactttggaagacatgactgaggaagagttcgaaacctttcgcgggatgtccgtgcaaaattatgcgaaacaaaacacaacgtcaggaacttggacggaaaaagaggcgtttgagaaatcggagcaggcatatgagaacatgattccgaatgggcgagacagcagcaatcattatttttggaacatcacaaatgaccaacgagaaagaatgggctggctctggctgtatgctgatccgtttcatccgcaaaaggaagcgtttatctattcctttggattgtataaagcctttcgcggaaaagggctggctcaattggcgcttcaaacgcttgatgaaaaagcaagagagcttggtgcggaaaggctggctctacatgtatttgcacacaacgagacagccgtctatctttatcagaagatgggctatgccatgaccaatattcgtatgcgaaaacagctatgctgaaaagtcgcttacgttacccaaacacaagatgcctatctggaagcagtggcagggtactataagtcatcattagaaacattaaggtcatgggaaggcttgaaatataaagaaaaaaggacaacagctgttgtccttttcaatgccgcttgaactttctccctcagtcttttttgtcttgatgatccagctcttttattcgtttcgtaagctcattgaaagcctgatcaagctccttataccctttatcatttggcgtcataaaactgagttttcccagcacttcttgtctttctgtctcaagctttaatcgaagctcttcccgctcatttctttctgaaggagcggcgtcatttaactgcttttcgatgccgttgtttgagatgacgagtttactgtttgttgttttttcgagaaagtatcggtcatgtgataccgccagcaatgtgccgctgtattgtgacagtgtttcttccagctgttcgcgtgacggcaggtcgagatggtttgtcggctcatctaaaatcagcacgtctttttcctccagaatataggccatcagcttgatctttacacgctcacccatactcatatgcttgatcggttcagtccattgggcggctgtaaaacctaagtgcctcatcagattttgaacgtgcccccttgctttgaatgtttcattcttaaataactcttccggtgtttgttctaaaggcaaatcaaacacctcctgcgttaaatagccgatgtttgctgacggcgacacccatacgcttccttctgctgtttcctgtcccagaatgatgttcagtaatgtcgtttttccgctgccattggggcctatgatcgcaaccttttcgccgtgctgaatcgtaaagtttgcgttcttaaagaggatcctttctccaaacgcttttgttacattctgaacttctaaaaaacgttttcctgttttgtgggttgtatcgattgaaaagcggactgtatattctggggtaacgggttccgcctttgctttttccaattctttttcaagccgcttctgcttggattttatctgggcatccgtacgcttcgcttttacccggtgatattctttaaacccttcctttttcgtcgattgagcatgggctttttccgaccaagaagcgagctcattcatttgtgcttcaatccgttcgaccattttttgctgcttttcatattcacgctgctgggtgagtcttttcttctcccggaacttcatatacccggagtaattccctttgaattcaatcagcgtctgatcctcaagcgaccatatttttgttgcggcttcgtctaaaaaatatcgatcgtgagaaacgagaatcacagtgccgctataatgtttcagctgttggatgagaaattgcaagcttttttcatcaaggtggtttgtcggttcatctaacagcagcagatctgcatcctctgatagtcctttcgccagccgcgctttcagtttttcaccgccgcttaactgatgaaaatcacgaagaggcacatgccatttctccagtaacttcttttcggcaggtgtctgatccgcaaaggaatacgccgcggtttcctgttcaaccaaagccagttttatatccttccgaaggatttgaccctgtgcaggggctaagtcattgtgaatgaggtgcagcaacgtagatttcccagcgccgttttttccgataatcccaatgatatctccttgctgaacactggcgtttacatgtttaaaaacagtttgatcctttacttcatagctaacgtttgttaatgttacgatctctttcatccatatccctcgctttaaagggagaataaaaaaatcctcccaaatgtgttggaaggattagccgtgcctgtgcatgatcaaataagctattttttataaatagcagtgtcgtatatatagaaaatgggcagactaatcctattttttgatttgaaatattgatttcaaacggtaaaaataagattagttaatcattgtccacccatcatcccttcttgttttgattacaaacactatagcatatcttcaaattcaaaagcaaaggtcattttcatcaaaaaaacccctgctctcatttttgaggcaggagtttcgagtgttattgatgcttcgcttttctcactttataaatcacaatcagcaaaataaaccaaaccggtgtgacaaataaggaaacacgagtgtcctgtgccagtgccagcacaaccagaacaaacgccaggaacgcaagaatcaggtaatttgtaaacggataaagcggaagcttaaacttgtttgttttcgctaattcaggtcttgttttgcggtatttcatatggcagatgaccgtaatcccccaaatgtagataaagcatacggttgaaatgcttgtgatcagggtgaatacgccttctggcatgatgtagtttaacgtaacacctattaaaatcacgatagccgaaaagaataaagcatttctaggcactttacgctgagtcagtttcgccattgactcaggcgcattgtgatctttcgccagggaatagaccatacggcttgtactgaatacagcgctgttgcatgctgaagcagcggatgtcaacacaacaaagttgataatacttgcagccccgacgatgccaacagcgacaaatacttgtacgaatgggctttcgctgggattgatgacatcccaaggatagatgctcataatcacgagaagagccccgatataaaaaagcagcacacggacagggatattgttgatcgccttagggattactttttcagggttttctgtttcaccggctgtaagcccgacaagctcaatgccgacaaaagcaaacacaaccatctggaacgagaggataaacccgtgcatgccattcgggaacaggcctccgtggctccagagatttgtgaagctggacactcctgagcttgtggaaaagcctttgaaaatcatcacaaggccaatgacgattaacgccaaaatggcaatgactttaatcaaagcaaaccaaaattctaattctccaaacagcttgactgtcgccaggttcataatcagtaaaataattagagcgattaagccaggcacccattgcggcacacccgggagccaatattgagtgtagagcccgactgctgtcagatcagccatcgcaatggaaatccagcagaaccaatatgtccagccagtgataaatgctgccatatcgcctaggtagtcttgtacaaaatccacaaaagagtgatagttcaagtttgataacagcaattcacccagcgatctcataattaagaagcaaatgatccctgtgatcatataagcaaataaaatcgaaggtccggcaaaatgaatcgatttgcccgagccgagaaataagcctgtcccaatggctccgccgatggcgatgagctggatatgcctgtttttcaagcctctctgcaacgtttgctgatttatattgtctttcgtcatgtcgtctgtcactttatgtgttcctccattgaaaattgtttattgagtcagcaatctatttttaatgattattataacactaaaatttctatcttttttactaaaaaaggattgatgaaaagaattttaatgtgatttggactatttcccgaaaaaagcggctccatttagggagccgcttttttatgctttttcagtttttttcataaacaggtagagcccgtaatctgtcggtgcggatgcgtagcctgcctgccgcagcattgctgtgatattgccgcggtggtatgtcccgtgattgacaacgtggggaagaagttcggaaacagttgttttcatgattccgcttgagggattttgaatctggagtggcttattgagctgttctttttgctgtaaaaatagtatatagcgctcggataacctcagaaaaaggtcttccatttcctctatttctttagcctctgtctgttctttaagctgttcagctaaagccaaagcatcgctcaagtttttgccggaaaacacttcaatccagccgagatcagaaagataaacatgagacaatacatgggatattgacggaaacacgctttgaatttcttgatggtatacctcttttggaagctcttttaatcggttgaatatttgttgattggcccagacgttatattcatacaatttgaatgccaaatctgacatgttaaaattccccctttcgtgtgtatagcttccattatacacgaacgtgcgttcttatgtagagtgctcgtgaataaaatttgttgacatatatagtttaggggaataaactaattgacattgaacataaagtttagcggggtaaactataatgaggaggggaagatattgaatgaacaaaagctatgtcaggcgataaacctgtttgtggaagtcctgcttgaagggacagaatttgtgcatcgtgaaatcaatcaggatgtcttcaagcatatctcaagggaacaggcagacctgttgaaaattttaaaagtcaagggcccaacatctcccggcagcctggccatgtaccaaaatgtacataagagcgcgatctctaacagactgaaaaagctgctcgaaaagggattggttcaatggggcgactgtccggaaaaaagtgataggcgctctaagcttattaacattacacccagtggtgaacacatactagaagaattagattcagccatctttaacgcgctcaaaccgctgattgatgatatagatgaggaacacttacattccatcatcgagatattcaccattttaaaaagcaaatttaaaggaggagattctgccgaatgagagcaatcatcaaattcaagtgggcaattgcagccatagtattagcacttaccgtcgttttgagtttgttttctccgaacttaacggagctggccaatcaaaaggggcaggcccagcttcccgctgatgctgtttcagaaagggcaaacgccattttaaaacaagcaggagaagacaataattcgatcagtgttgtctttacattagacaacgctttaaagaaagaaacagagaatcagctccggataatgatcgataaaattaaaaagatcgacggtgtagaagaggtaacatctcctctgtcagcggaaaaagaagtcaaagaccagttgatgtcgaaagacaagaaaaccgttctcatgcctgtcacgattacaggttctgataaaaaggcggaaaaaatcgcggacgagatttatcaaatcgttcctgatgacttgacggcatatattacgggagcttcccttatcaaccaggatttcgctcacagctcagaggaagggcttaagaaaacggaagtgatcacagtctgcctgatcatcggtttactgttgatcgtgttccgatctgttgtgacgccttttatcccgattgtggttgtcggtttttcttatctgatcagtcaatccatactgggcatccttgtatacaatgttgattttccaatctcgacgtttacgcaaaccttcttagtcgcgatcctgttcggcattggaacagattactgcatactgcttcttacacgattccgtgaagaattggcaaacgggcatgataaaaaagaagcggcgcttatcgcttaccgcacagggggaaaaaccttatttatcagcggatttgcggtattgatcggattttccgccttaggatttgcgaagtttgcgattttccaatccgcagtaggggtagcagtcggtgtgggaattttaatgatcatcctctacacactgctaccattatttatggtgacgctgggagaaaaattattctggccttctaagaaagtgctgtcacacagtgataacaaactatgggcgtttctcggcagacactccgttgcgcgtccgtttctgttcattgtcatcacggtggtgattacgcttccgttcatcttgacctatgatgaccagatttcattcgactcaactgcggaaatcagcagcgattataaatctataaaagctctcgaggccattaaggatggattcggggaaggaaaagcgttcccgatcaatgttgtcgtaaaaggagacaaagatcttacaacagctgatacaatcccctatctaggaaatatcagcaaagcgatcgagaaagttgatcatgttgactctgttatgaccattacgcagccgactggtgaaaaaatcaaagatttatatattgataaccagctaggatcggtttcagacgggctggataagacggtgaaagggattgccgatgtccaaagcggattaacggatatagaaaaaggactgaatcaaatggcagggcaaaccggctcggcctcaaatggagggtctggcggttcactgggcgatgcggcagatggcttgggcaaaatcaatcagcagctgcagctcgtgagcaaacagatttcccaaaccggcaataccgcacagaccgtgcagcagcttacggcaatcagcggacagcttggccagattcaaaccggccttgaacaagcgaaccaacagctctcaggccagcaggcacaagccggaacgctgacagaaagcctaaagaagctgtccgaaggtgtgaggagcgcaaatcagggcctgacgaaagtctctgacggtattacagcttccagtgatatgttagaggatatgagcaaaagttcaactgtaagagatacaggcatattcattcctggtcaagtaatgaaggacaaagactttaagaagtcaattgaccagtattcctttgcagacggcaaaggtgttcaattaagtgtcgttctggattcaaatccgtactcagaacaagctattgcgacaataaaccaaatcaaaaaagctgtcgcaaacgaagttgacggcactcctttggaggatgcacagatcgtatacggcggggtcacgagtatgaacgcggacttaaaagagctgtccacaacggacttctccagaacaatggtgattatgattataggcctgtttatcgtgttaaccattttgttccgctcaatgatcatgccgatttatatgatcgcgtcattgctgctgacgtactatacgtcgatatccataacagaattaatttttgtaaccggcttaggaaacgcgggtgtcagctgggcagtgccattcttcagctttgtcatcttgatcgcgttaggggtagattattcaatcttcttgctggatcgatttaaggaagaggtgcaccttggcattgagcaaggtgtcgtcaggtcaatgagcaaaatgggatctgtcattattacagctgcaattatattggccggtacgttcgcggcgatgatgccttcaggtgttaatacactgatgcaggtggcaagtgttatcatcatcgggctcttgctttacggctttgtcattcttccgcttttcatcccggcaatcattgcgacctttggagaaggaaactggtggccgttcggcaggaagaaaggaaaagaataatcgagagaagagtgatgaatggtcatcactcttttctcatgactaaacgacgaacttcagacgtgttacccaaaaaaggtcagacgatcaaacggcggctgtacttaaaaacaaagagcccggaaaacattcccgggctctttgttttatttccattctgcaattgtatcaatcggcagacggtaggaagcatagccttcgtctgctgcttttccgatagaaagtagcataaccggtacataacgttctttatctaatccgaaggtttccgcgatgttttctttatcgtatccgccgatcgggtttgtatcgtagccatgcgcgcgtgcagtcagcatcagctgcatggaaacgagacctccgtcaatcaggatcgtttcacggttgacctgtgccggaagcttttcaaaatgtgcggtcagcgcggcgatttgtctgtctttgacctcctgcggcatgtaaccaagttccacggcttttgaatagatttcttctaagtagtctgcattgttcatgtctgcaaatacagcgatgacagcagatgatgttgtgacctgtgtttggttaaagctggcaagcggtgcgagcttttcttttccttccgggctgtcaatgacaagaaaacgccatggctgcgcgttaacagaagatggggcagttgttgcttcctctaagatctctgtcatttcttctttgctgatttttactgccggatcatagttgcgaatcgaacggcggcctttcataatttccataaaatcgtttgttttgatcatgttgatacactcctcttaagcttcgatattatttatattgtttcgcatgcgcgccagcacatcaatgagcaggcggcgttcttctgcgcttacatttgcgagcatttccttcatgaaacgctccttttccttcttagaagactcaattcgctctcttccttggtctgttaaccgaacaagggtgatgcggttgtcctcaggcttgcgccgccttgataccatgcctttggcttccagctgtttcaggtgtctggtaacggctgcgctatcaatatttacttttttttgaaggtcgctttgactgatctcatctgcatgataaagcaatgtcagcaattccaaacgagattggctgatgcccgtgcatgcctcgaacttcacgccaatcaccttgttcacgccttgcagctgatataaaatctcggcttcctctgaacaaaatgacgccaaaacccatcccttctttcctgtcaaaactattaattgatatatcaatgattgacatgtcaattaatatacaacgattgatttcatcttgcaagccatttgcactctagaaaaacctcccagcgtataaaattcgctaggctagaacttagcaaaaaaagttggccgcttcttcagatgatgctggtcacgatgattccctgcatcattcccatttataggtgttcggaatatcactttgccgagcccatgctcaagcggctttcacaggctgaaagttatgatacaatatacaaatgtttcacagcttcaatccatagttggagctgacatccattatataagggactagattgaagggaaggtttgataacatgctgcacaatccaactggaaaagaacgcttggcactagcgtttctgctcggcatgcttgctatattgggcccgcttaatatagatatgtatttgccaagttttcctgaaatcgcggaagatttatcagcaagtgcttcacttgttcagttaagtttaacagcctgtctggtcgggcttacgatcggccagctgattgtcgggccggtcagcgatgcgcagggaagacgaaaaccgctattaatctgtatttttttatttgcgttatcttctctgttttgtgcactgtcgcccaatataacaactttagtggctgcgcgttttttacagggcttcactgcttctgcagggcttgtgctgtctcgcgcaatcgtccgcgatgtgtttaccggaagagagctttctaaatttttctcgctgttaatggtcattaccgcggtggcgccaatggttgcgcctatgacaggcggtgccattttgcttttgccgttcgcaacgtggcatacaatttttcacgttctcatgatcatcggatttttactagttcttctgattgcattgaggttaaaagaaacgcttccgccggaaaaacggattccaagctcaatcggaacatccgtcaaaacgatgggcagcctgctgaaggatcgatcctttatggggtacgcgttaactgtcggatttattcacgggggaagctttgcatatgtgtctggtacgccttttgtataccaggatatctacggggtgtctccgcaggtatttagtattctttttggcattaacgggctggcgattatatcgggcagctttatcatcggacgctttggcggaatcattcatgaaaaaagcctgcttcgtatagcggtcattacggctatgattgcgacggctgtgctattaaccatgaccatgattcacggtcctcttgctacattagtcatagccattttcatttacatgattacgatcggcatggttctgaccagcacgtttaccttggccatggaaaagcaggggcaccgcgccggaagtgcaagtgcgctgcttggaatgctcccgctgctcctcggttcaatcgtgtcaccgcttgtaggcattaatgagacaacagccgttccgatgggagccatcatgtttgtgacagctgtcatcggctcactggcgttttttggattaacgaaagaacgagtagggcagaattcataaaaaaacctgacatgacgtcaggttttttgttttatttagaataacaacagcaggcctgcaatcgccggagtcaaaaagatggctgatttcaaaaccacctttggcatgaggttggtgaatttcgcgcctacataggcaccgcacattgtcccgaccagaactttgatcagcaatacataatcaacaaaaccttctgtgatatatccgatgcctccacctacagccagagggatgatcacaagcatcgtcgttccgacagaatggcgaatggacagattcagcataatcattaaaccaatttgaataaaaggtgccgacccgatgccgaatgtgccggaaagaacgccggctacaattcctaagatgaccgctctcgtatacgttgaaagagtgctttgattcacttgagccttctcttttaaaataaataatctgattaaaatgagaattgctgataaaaataacattccagccgtcaaataatgaagcaaatcagccggaataaaagatgtcagcttggcgccgaaaaatgagccaaccgcagcaaagcctccgactattaagccgattttcatttgaatgttgccctcgcgatagtggctatatgcccctgataagcttgtaaaagccatgccggcaagcgaagtgcctaaagccgtatgaatcgggatatggaaaagaagcgttaaaagggcaatgacaaagccggctccaccggcgccaataaagcctaaaataattcctagaagaaacataacaagaataatgagcatattttttcctccattgaaaagatgtaaaaatgtaatcgtgcgctattctggcggaggtatggtgtcctattgacgaagaaaaacacgccgttttttcagttgccagtagtccgtcgaccgtcgttcaacaaacatatcgtacctcaaattctgggatctgacaaggcagtttgttgcttcccattaccatctgttatatgattttgatgaagaaaagcctttgaatatattcaaaagaggtattatatatggacgattttaaattagataagccgactccctactacctgcaattttataaccagctaaaaaaaatgatcttcaacgggacttttaagcccggggaacggataaacgaaacacagctggcgaaaagctttggcgtcagccgctctccgataagggaagccatgcgattgcttgagaaagatggtttgttaaaagcggatgaccgaaatgggttttcgatcacgtcgttaacggcaaaagatgtagatgagatttataaaatcagaattccgctggagcagctggcagtcgaattagtcatagacgaagcggacgaagaagagctgaccatactcgaaaaacagcttgaagaaacagagaaagccattcacaacggcacggaagatacggaaatcattcgtttaaatcaaaaatttcatgagctgctggttgatttcagccataacagacatttgaaaaatttgcttgagcatgtaaatgacctgattcatttttgcagaatccttaattataccggcgatcaccgtgcagaaacgatactgagtgagcaccgcaggatatttgaagaagtgaaaaagaaaaacaaagaagcagccaaacaacatgtactggctcatttcaatcatgactgtgagcatttgaagcatgtgcttgaagaaggtaaagagaattgatttctatgatccggtaccaagggggagcagaacccttggtatttttttatgtattcaccacatatctaagaggccccgttaataagattttatgatggtttgactaacgaataatgggggttaaacatgtttatccatatcgtcgggcctggtgattctttgttttcgataggcagaagatacggtgcttctgttgatcaaatacggggtgtgaatggtttagatgaaacgaatatcgtgccggggcaggctctgcttatccctctttatgtatatacagtccagcctggagatacgcttaccgccattgcagccaaagcgtttgtgccattagagcgactgcgagccgccaatccgggtatcagcccaaatgctttacaagtgggagcaaaaataacgattccttcgatctcaaattacattgcgggaacgttaagtttttatgtgctccgaaacccagacctcgatcgagaattaatcaatgattatgcgccatactcgtcttcgatttcaattttcgaataccatattgcaccgaacggcgacattgcaaaccaattgaatgatgcggccgctattgagacaacttggcaaagacgagtcacgccgctggcaacaataacgaaccttacatcaggaggcttcagtacggagattgttcaccaagtgctaaacaatccgacagcgagaaccaatctggtcaacaacatttatgacttagtttccacaaggggatatggcggtgtcacaatcgattttgagcaggtgagcgccgcggatcgcgatcttttcactggatttttacgccagctgagagatcgacttcaggcgggagggtatgtgttgacgatagctgttcctgcaaaaacaagtgataatattccatggctgaggggctacgattacggggggataggagcggttgtcaattatatgtttatcatggcttatgattggcatcatgcgggaagtgagccgggtcctgtagcgccgattactgaaataaggagaaccattgagtttacgattgcgcaggtgccgagcagaaaaatcattatcggagtcccgctctacgggtacgactggatcatcccgtaccagccgggcacagttgcttcagcgatttcaaatcaaaacgcaatcgaaagagcgatgaggtaccaagctccgatacaatattcagccgaatatcaatcaccgtttttccggtacagtgatcagcaggggcggacgcatgaggtatggtttgaggatgtcagaagcatgagccggaagatgcagatcgtccgcgaatacagattgcaggctattggcgcttggcagttaacgctgggctttacaccgggcccatggcttctgcggaaattttttacgatcagaaaagtgtaaaaaaagacaccacaactggggtgtcttttttttgattaagtccagagcagcagaatagttcattcatttgtaccttgcataggttgtgttcccattttacgattagtagtagtctgatcaaacaaagagtcagaatacgatttgagagggagttgtctacatgaagacagtattgattttgaattttcctgcggaaggccatgtgaatcctaccttaggcattacaaaagcgttttccgataagggatatgatgtccattatatatccactgaaaaatataaaaaacgattagaagcagcgggagcaacggtccatcttcaccgggatctgctgcgaacaacacctattcatgtcggttcgcccaatggcattcttgatttcgtgaaaatccatatcaaaacgtcattggacattttacagattgtcaaagacttatctaagagcattcaatttgattttgtttattatgataaattcggcgcgggggaattggtaagggattacttagatattccaggagtctcttcatcggcgtctttcttgtttggcgaggagcacctgaaaatcctgccgctgcatccggagtctggagcgccgcttgaattggatcaagagtgtgaagatcttttggcaaaaatgaaagaaacgtacggtgttgccccgaaaaacctggttcaattcatgaacaataaaggggaattgaacgtagtgtatacaagccgttattttcagccagaaagtgatcgtttcggggatgaatgtctgtttatcgggccaagctttccaaagagagcggaaaaaacagatttcccgattgaacagctaaaagatgagagtgtcatttatatttcaatggggactgtactggatcatacagaggatttcttcaacctttgtattgatgcattttcaggctttaacggaaaagtcgtcatcgctgccggagaaaaagcggacctgaccaaattaaagcaggcgccggaaaactttatcattgctccgtatgtccctcagctggaagtgctggagcaatcggatgttttcattacacacggcggaatgaacagcgtaaacgaaggcattcatttcagcgtgccactggttgtcatgcctcatgacaaggatcagccgatggtggcgcagcgtctctctgaactccatgcaggctatgtcatctctaaagatgaagtcaatgcccaaatattaaaacaggccgtagatgaggttttgcgcaaccatcagtatacggcaggcattaaaaaaatcaatcaaagcttcaaggaatgtatggacatggaagaagtgatggagcggattgatgagttgattcgccaaaaaaacaaataagaaaaagaactcccgtaccttgtacgggagttcttgatttaaaacttgattttgattttttgagcatcactgattttcttatggttatggtcaaagacgtcacttgtcgtgatttcgatccacttgatctcttttgttttcttctcagcatccgcggccttatcatgagcatggcggcttgatgcgttcacaataaagccgagatttccagacttttcggcgccgccttccaattcgccgtttaactcttcaagataaatatctttgttccaatcaaaggtttcgcccgtatttgttttcatcaatgcaatcggcgcaacatttactttttttgaagaggtgttcttgatatcaacgaaaaccttaacgaaatcaaactcttcatcgtgtgttaactcatgaaagtaatcaatcatgctgtagtccgggcgcaagtggatcagcttcatttcttttactgttaactccacgtcgccaatcttataggttttgttcacttgtttgatatcttttaagacagcttttcctttatcatctgaaaacgtttggccgaccttaagcaatgaccggtcatcagttacctgggaattaggctgataattatctgtgctgtccttctgggatgaagtgctttgcggctcagcttttactgttttctccccgcctgcatgctgtttttcagtactggcgtttgatgagcagcccgcaagcatgatagcaaaaacgaaaattgaaagaattcttctcatgatgattcctccattaaaaagagatcccgttacttcatacaagcaacgggacaccttgtattcttttacttatcgttaatcttaatgttgtattgtaaagccttgaaaacatttttggcgatttctgtattatcaatttggccggcaaatgtctcactagacggaccgtatgcatagacgggcacatcttcaccggtatgtccgcctgttgtccatccagtgtgagagcgtttattaaagatgttctcgattgcgttatcgatatccagtacttccttcgattttgccgcttcttcaacagattgaatttcggcttttgttaaagccaatttcttttgatcgatatatgttttcaacgttttttcaacatccgcgccgtcagagatcttttctgccataaagtcaggtgtgcgctttgcggctttaatgggttcactgaaccaattgtagatgccgtccgcaccgatggaatatccgccggttgagtggtcagccgttgcgacaaccaatgtgtgcttgtcttttttagcgaaatcaatagccgccttataagcttgttcgaagtcttccatctcgctcatggcgccgacgatatcattgtcatggcccgcccagtcaatctggctgccttccaccatgaggaagaatccgtctttatccttgtttaattttttaatggctgtgtttgtcatatctttaagtgatggaacatccttcgtccggtcaatctttttaggtaggccgccgtcagcgaataggccgagaacttggctgtctttgtttttcagcatgtctttgcgatcatccacgtagctgtaccccgcctttttgaattccttaatcaaattacggtccttacggtcaaaattgctctttcctccgcctagaaggacatcaattttgtgcttgctgttgaccatctcatcaaaataatcatccgcaattgagttcatattttttcggctgtggtcgtgtgaaccgaaagaggccggagtggcgtgtgtaatttctgaagtggccacaagtcctgttgcttttcctttttctttcgcagcttcaagcaccgttttggcttctgatccgtcgttatccaccgctatggcattattgtatgttttaattcccgcagacatagccgttgccgccgctgcagaatccgttacattttgttcaggatcatcggggtaagttgtttgctggccgacaagatactgatcaaaagccgtaggctccacaacttttgtctttttattatcctttaagtatcgataagcagacgtataagacacacccataccatcaccaatcagaacaataacattcttaatttcgtcttggtttccctttttcttttcctgggcgctggcttcaggcacactgccgctggctaagctgctgaacgcaattgatgataaaaccgcgataggcagtaattttttcgggaattttttcaactggataacctcctaaatatagatgaatctcaatgacaacccaattatatttttaaactgttaagctagtattaatcgattttaaagattggatttacaagaataatgaactgnnnnnnnnnnnnnnnnnnnnnnnnnnnnnnnnnnnnnnnagaaggaaagagtgatagtactatagaaataaattggaggaatagatactggccgtggataggcggactgaaatctgctatagtcgcatagaagcaacccgcttacatcttgaacaattgtaagtattatgttggaagaggtattgtgtaagtacatgtctgagcagttcatatggagtggcatcattttattttaggagggaacaacatggacgttttttctgagtatttagcggggattgatgacccgttccaccgagaaagaacagaagaggtgttaacttggataaaaaataaatatccaaatttacatacagaaataaaatggaaccaaccgatgtttacggatcacggtacatttattattggctttagtgtttctaaaaggcatttagctgtcgctcctgaaaaagtaacgatagcgcacgtagaggatgatattgtgaaggcaggatatgactacaccgagcagctgatacgtatcccttggaacgatccagttgattacacgctacttgagaaaatgattgagtttaatattcggaataaggcagactgctccactttttggcgaaaatgaaggaaaaaggcataacatatgagctgtataaaatatgttacaccttttcatttgtctatttttcgttttgatcatctattgctgcttttcttcaaacaaggtcttttcattgagcgtaagctggctcgcagaataatgattaccttgtttccatttcacttcaatcgtaatatcatggccttcaagctcatgttcatctaaccgctctaaaaaagaaacggacttttcttttgcgcttccatcagaaaaagtgcctccagcataatcatgcatcgggatttccgtgtcagaactcagcagaacttcatcatccttttttacaatcagtgattccaaataagtgttgtctgtttcatgtggtccaccgatccaataaagtttgccgctgtattcattcggtgcatcttcattttttttgaaaacagcttcccaattctggtctttgctttctccctgccaattcggatactccaaacgaacatgatgaatcaggtgataggaaaaaaagatcaagcagaaagcgattaataggaatgccgtgaaaatgagagggtatttataatgactggacataaaagactcctattcgtttaatcaattaccttcgaaaatagaatttcatccagaatcaaaatgccgttttcagccacctcgggaatctccggcttgagtcggcgtgctttttcaactgcgttcggaaacactgcagcgaattgatagcctctcttttgataaaacgccatcgcatctacattatcattcgttgtgataagctttattcgttgacaatgtgcatgtttagccgtctcttcaacctgctgaagtaaagctgtgccgattcctttattttcaattatactatctaatgaaataatttcacaatctttcccatctattgtgaatgtaatacagccaatgatttcgccgctttcatttactgcggcaaatccatctaattcatcacaccgaaaaatgccgctggaaatcgccatctcgggtgtaccccaatgcttggcaaaaaaagcggtcaacatatgtttcgctatctcattgtttgggatgatgatcatcgtaacactcctctattgaaagatttcatgtgtattatcaatataaacaatatataacaaaaaaatagatgttgaggtgacagcatggaaatcagcgatgtcatttacgggtaccaccatatagacggagtgctggaagagcttatcaaaagcgctcctgtgcaaagattaaaagggatctatcaaggcggagcaagctttttagtcaatcgaaggtggaatgtgaccaggtatgagcactccatcggcgtaatgctcctcatcaaaaagctcggaggaacgatagaagaacagattgcgggtctgctccacgacatatcacacacagctttttctcatgtggtcgacgttgtctttgaaaatcaagcagaagactatcatgaaaacatctatcaacaagtcattgttcactctgaaatcccggacattttacaaaaacacggctatcatactgaagaacttttatctgacgattcaaggtggacattgctcgaacagcccgcaccggagctgtgtgctgatcggacagactatacgctgcgtgatatgtaccgatatggacacattagcctgcacgaagcgcaaacctttttggatcatcttattgtgagaaacggaaggatgtttccggatagtgttgaagccgccgaatggtttgtcagtgtgtactacaaggaagtgattgatttctttttgaatcccgtgaatgtatatggatatgaatatttagcgcgagcattgaaggcagcgctgcggcatgatgtcatatccgcagaggatctcctgaaaacggaccaagaggtactgaacatcctgcgtgcatcaaaaaatgaagaagtcctgagcttgcttacatccattcatcccggcatacaagtaatagaagatgacatccagtacgatttccatcaaaagaagaaaatgcgcctaatcgatccatccatttttcttgatggcgaatggatcaaatcctcagatgcttctgaaaaggtgaggaaaatgggtgaggctgcttatcaaaaagcaaaaaaaggtgtgtatataaaaatcttaaaacagtaattgccgcctgacagcggcttttttcatgtttggctttgcaaacaaaggggaataggacaaactgcgggaatgctttatgagaatatcagcgtatttacataccgttcgggggtatagtattatcgatagggcatgttttcattgtctgcgggcaaaagttacagggaaaaatgaagcaaaggagaatgaacatgaaaatctctaaaaatgcactgggaattctgatgttatctcttgttttagttttatcagcatgcggcaataacaacagtacgaaacaaagcacacatgacaatcattcagactcctcaacacatgaagagatggaccattccggatcagctgacgttccagagggattacaggaatctaaaaatccgaaatacaaagtaggcagccaggtaaccatcaatacttcccatatgaaaggcatgaaaggtgccgaagctacggtaacaggcgcctatgatacaacggcgtatgttgtttcttatactccgactaatgggggacagcgtgtggatcatcacaaatgggtgatccaagaagaaatcaaagatgccggagataaaacgttacagcccggagatcaggtgattttagaggcttctcatatgaaaggcatgaaaggagcaacagccgagatcgactcggcagaaaaaacaactgtatacatggttgactatacatcgacaacgagcggcgaaaaagtgaaaaaccacaaatgggtcacagaagatgagctttcagctaaataataaaaaatcctccttttacaaggaggatttttttgctgtttgaacaggtcttgttaaagaaatgaaagcaaacaggacagcgatgatcacaattgacccgccgcaccatgctgttgacactacagtacccgtctgatccaaaacaacaccgccaatggctgagccaagggcaattccgacttggagggccgacgtgttaaagctttgctgaatgtcagacgaatcaggtgcaatttcaattaaatagctttgctgagccggggcgaggctccagctcagaagaccccaaatcaccatgacaggcaaaaagaaaatcatagacgatgtagacagcggcagtaagaacataatgatggcaaaggaacccgtcaccagcaaaatgctcttaaaggaaccaagccggtcagatagcgctcctccgaaagggcctccgcatacagcagatatcccgaaaaggaaataacaaatgctgacccagaaagagctcaggtgaagagtctcttctaaaaacggtgcaaagtaagcgtaaagcgtgtagtggccagctaatgtaaacatcgtgacgaggtgtgaactcgcgattttcagattaccgatcgtcttgagctgttcccggaaaggaatcattttctccgccggtattctttcaaagaaaattgaaataatcagcatggagatcagcgccaacaggccgatgccaaggaacaaaatccgccacccgaaggaatcgctgattaagattccgagcggcacgcctaatgcgatagcagagctgaaacccataaaaataattccgattgcgcgggctctgtattcaggcgctacaattttcggggcaattgttaaagaaagcacaacaatcagccctgtactcattgctgccaataccctagataccatcaatgtggcgaaattagggctgaaataggcgacaagattgctaaggaagaaaacaaataaagcaattagatataagcgcttccgctcaatcttcgcagtcaatgccaaaagcagcggcccagatactgcatatcccagcgcaaacacactgatcagctgtccggctgaaacaatggaaatgtctaaatcatttgcgatctgaggaagaatcccccccacaattaactcaaccaatccgactgcaatcgtagaagctgcaagcaggaaaactttgaaattcataacaaactcctttacttaaatgttttgataaataaaaaaaatcctgattacaaaaaatgtcataaacaaattttgtaatcaggattttacggttcctggtagacaccctcaaaccatattattgaggttatacaagtgataatagctatttaattgattcgtttccgttgatgagtgtaccacattatgaatgaatcttccatagaaaaatttacaaagtgatgaaccggacaagtgtatgattatatttattttataaaagtatagacatttaaaaataaatgactataataatccgtgtaagcgttttaatcacaaggggggatagcagttgaaaaaaatattactcgcgtgcagctcaggaatgtctaccagtttattggtgacaaaaatgaaggaatacgcacagtctatcggtgaggaagcagagatttgggctgttggccaggataaagcaaaagaagacatgagaaaagcggatgccgttttgatcggtccgcaaatgagctttctgaaaagcgaactccaaaaagaagcggatcaatacaacattcgggttgaagtcattgacatgatggcctacggaatggcagatgggaaaaaagcgtatgagcaggcattgtccttaatggagaatcaataatggaacaggtgaaaatcacgaacttaacagacgaacaaatcagttttcagcttatcctgcacagcggcaatgcccgcagctgcatcatacaatcactgcgcgcctacaaagaagggaacaaggatgaggcggatgccctcattgccaaggctgagcaggatttatccgcggcccatgacattcactttcaaatgatacagaaggaatccggcggagaagcacaagctttctcattgctgcttatgcatgcagaggatcatctgatgtcgacattatccatgaaagaattagtgaaagagatgcttgatctctttaaaaccaagaatctataaataatcggggtggatagggtgttcgagaaaatcagccaattccttgttccaattgcagggaggttaaacaataaccgctatttgcaagtgctgcgtgatgcatttatgctggctttcccgctgacgatattcgggtccatttttgtcgtgttaacgaatttgccgtttctaaacaaaatcatgaacgcctcaatgcttacgtcgtttcagtctcatttcggcattgcctccacggcgacaatgggcattatgtctgtctttgttgtgttcgggataggctattacctgtcaaaaagctatcaggtcgaagctgtatttggcggagcgatcgctttggtttcctttttgctcttaacgccatttatcgttcagccggaaacaggagatgccgttacaggggttatcccggtcgaccgtctcggtgcaaaagggatgtttcttgggatgattacggcatttctttctggcgaaatctacagaagaatcgttcaaaaaaacctgacaatcaaaatgccagccggcgttccgcctgctgtagcaaaatcatttgccgcacttattccggcttttatcacattgaccgtatttttgctgattaacgtaatggtgactctgttttttaaaacaaatatgcacgacgtcatttatcacgcgattcaggctccgcttgtcggacttggaagtggtatcattccaacgcttattgccgtgtttttcattcaaattctttggtttttcggactgcatggacagatcattatcaactccgtgatggacccgatttggaatacactgcaggtagaaaacctttctgcttacacggcgggaaaagaaatccctcatattatttcaaaaccgtttatggagatttatacagtagggatgggcggaaccgggatgacgcttgcgattgtgtttaccattctcatattcatgaaaagcaggcagatgaagcaagtatcaaaacttggcctcgctcccggtatttttaacgtcaacgaaccgattatcttcgggcttccgattgtcatgaatccgatcattattgtgccttgggtgctggcaccgatggttgttacgctcgtcacctatctgactatgtcagcagggctcgttccgcctccgactggtgtgacagtgccgtggacggttccattattcattaatggtatcatggcgacgaactcaatcatggggggcgtgatgcagcttatcaatctgctgattgtcttcgtgatctggtttccgttcctaaaagcaatggataaattaaatctggcaaaagaaaaagaacagtctgtgcaggagacagctgctcagcaaaatgataacagcataaaaatgtgacataaggggagagagacttggcacaaacagaacaatatcgttttccaaaggatttttggtggggatcatccgcttcagcaacacaaacggagggtgccgccgacagagacggaaaaggccagaatatatgggattattggtttgaaaaagaaccgcatcgtttttttgatcatgtcggacccgcagacacatcccaattttacgacaactataaagaagatatcaggctgatgaaggagcttggccacaactcgttccggatgtcgatttcctggtcacgtttaataccaaacggaacgggcgagatcaacgataaagccgcaaatttctataacaatgtcattgatgagttgatcgctaacggaattgaaccatttgtcaatttgtttcatttcgatatgccgatggcgcttcaaaaaatcggcggctgggtcaacagagagacggttgacgcgtatgaaaactatgcgagaacgtgcttccgtttgtttggcggccgggtgaaaaaatggttcacgcataatgaaccaatcgttcccgtagaaggcggctacttatatgattttcattatccaaacaaggtcgactttaaagaggccgtccaagttggatttcatacgatgttatcaagtgcccgcgccattcaggcttacagggagatggagcaggacggaaaaatcggtatcatcttaaatttgaccccttcatacccgagaagcagccatccggcggatgtaaaagccggggaaatcgcagatgcgttttttaacagatcttttttagacccatctgtcaaaggcgaatttcccaaagagctggttgacattttgaagcatgaaggctttatgccagattacaacgctgaagatcttgacatcatcaaaaagaacacggttgacctgttgggagtgaattattaccagccgagacgtgtgaaagcgaaagaacatcttccgaatcccgacgctccttttttgcctgacaggtattttgattcctacgtcatgccgggccgcaaaatgaatccgcatcgcggctgggagatctatgaaaaaggcgtttatgatattttgattaatttaaaagaaaactacggcaacatcgagtgttttatctctgaaaacggtatgggggttgaaggtgaagagcgattcagggatgaacaaggcatcattcaagatgattaccggattgaatttataaaagagcacctcaaatggattcaccgcgccatacaggaaggctcgaacgtaaaaggctatcacttatggacgttcatggacaactggtcttggacaaatgcctataaaaaccgatacggatttgtatcagtcaatcttgagaaagacggagaaagaaccgtcaaaaagagcggaaaatggttcaaaacagttgctgagcatagcggtttttagattttcctaaaggtcaagatcttccggcaatcatcataacgaatagagatgacgaaaatccgcaacattgatgaaatagggaaaagaacttatgatatccgtaaaagcttatgtgatatcagactctaacagctgccggaggatgccaatgaataaatacgaaattattgcaaatgaaatgagaaatagaattaaaaataacgtatatccgatcgatcagcccattcctgatgaagtatctcttgcaaaagaatttaactcaagccgcatgacgatgaagagagccttggataatttagttgccgagggtctgctgttcagaaaacgaggccatggcacgtttattattcaatctgcaatacaggatgaccatgtacatgtagtcagcaatgagattctcggattgaccaacttgctgaaagataaaaaaatccaaagcaaggtcattcagtttgaagtgcaatttcccactgaggaagtggccgcccatttgtctattgatcagaaaacaccggtttattatgtcgttcggctgcgaattgtagaaggtgaaccctatgtattagaaaaaacatatatgccgactcatttaataccgggcattaatgacgatgtccttcatgattcgatctacaatcacattacaaatgtgctgcagctcaaaatcgccggaacgcatcggaaaatcagagcctgcaaatctgatcatattgaccagcagcatctgggctgtaaacaggatgatccaattcttgaagtggaacatgtgggcttcttagataccgggattccatttgaatattccttttcacgtcatcggcatgacaagtttgttgtgacttctgtaaacatacggcgctgattgcggagacaacaaggaggccatctgcatgcttggcggtattgaagcaggcggcacaaaggttatttgtgctgtcggtaaagaagatggaacaatcattgaccgaatagaattccctacaaagatgccggatgaaacgatagagaaagtgattcaatattttcgccaattttcattacaggcgatcggcatcggctcctttggccccgttgataacgataaaaccagtcaaacatacggtaccattatggccacgccgaaagcgggctggagacactacccctttttgcaaactgttaagaacgaaatgaaaattccagtcggatttagtacagatgtcaacgctgcggcgctgggtgaattccttttcggtgaagcgaagggtctcgacagctgcctgtatataacgattggtactggcatcggtgcgggcgcaattgtagggggcaggctccttcaggggctgtcgcacccagagatgggccatatttatatccggaggcacccggatgacgcataccaagggaagtgtccttatcatggagattgctttgaaggcttggcttccggtcccgccattgaagcgcgctggggaaaaaaagccgcggatttatcaggtatagcacaagtctgggaactggaagggtactatattgcccaagcactggctcagtatattttgatccttgcacctaaaaaaatcattcttggcggcggcgtcatgcaacagaaacaagtgttttcttatatctatcaatatgtaccgaaaatcatgaacaactacttagatttttctgaattgtcagatgatataagtgattatattgtacctccacgtttaggcagtaacgccggaatcatcggcacgctagttttagcgcatcaggccttacaagcagaggcagcatccggggaggtgcgatcatgacgcatccattatttttagagcctgtctttaaagaaagactatggggagggacgaagcttcgtgacgcttttggctacgcaataccctcacaaaaaacaggtgagtgctgggccgtttctgcacatgcccatggcccgtcggctgtaaagaacggcccgctggcaggaaagacactagatcaagtatggcaagatcacccagagatattcgggtttccggatggtaaggtgtttccgctgctggtaaagctgctggacgccaatatggatctctccgtgcaagtccatcctgatgatgattatgcaaaactgcatgaaaatggcgaccttggtaaaacggagtgctggtatatcattgattgcaaagatgacgccgaactgattttgggacatcacgcaagcacaaaggaggaattcaaacaacgaatagaaagcggtgattggaacgggctgctgaggcgaatcaaaatcaagcccggagatttcttttatgtgccaagcggtacactccatgcattatgtgagggaacccttgtccttgaaatccagcaaaactctgatacaacgtatcgcgtatacgattatgaccgctgtaatgaccagggccaaaaaagaactcttcatatagaaaaagccatggaagtcataacgataccgcatatcgataaagtgcatacaccggaagtaaaagaagttggtaacgctgagatcattgtttatgtgcaatcagattatttctcagtgtacaaatggaagattagcggccgagctgcttttccttcacatcaaacctatttgctggggagtgttctgagcggatcaggacgaatcataaataatggtattcagtatgaatgcaatgcaggctcacactttgtcttgcctgcgcattttggcgagttttcaatagaaggaacatgtgaattcatgatatctcatccttaatgaatgggggagttgcatttgtttaagaaacatacgatctctttgctcattatatttttacttgcgtctgctgttttagcaaaaccaattgaagcgcatactgtgtcgcctgtgaatcctaatgcccagcagacaacaaaagcagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagagggtggcttgaaacagctaaaattgaagattcaatagatgtaagctgcaacggtgatttaatgtcgtattggaaaaatggcggaattccgcaaatcagtttgcacctggcgaaccctgcttttcagtcagggcattttaaaacaccgattacaaacgatcagtataaaaaaatactagattcttcaacagcagaaggaaaacggctaaatgccatgctcagcaaaattgctgacggacttcaagagctggagaaccaaggtgtgcctgttctgttcaggccgctgcatgaaatgaacggcgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagtcggcccgcaaacagcaaacggcagcttcgattacagcctgttcatcaatgctgtaaaacaaaaatatcctaaaaccatttactttctggcatggaatgatgaatggagcccagctgtaaacaagggtgcttcggctttatatcatgacagctggacactcaataagggagaaatatggaacggcgattctttaacgccaatcgttgaatgaatcagtaatgtacaataagaaggtgctcaagaagtttcttgagcaccttcccactggattaagcattcatatcgcctaacccaggactgtgttcatttggtatttcaggaagcactggtacgggaaaccctgccggaggatctattacttgcaactctccgccatttcggcttggagatttcccttgatagatttcaccgattctcgtttcatccaacctaaagttaaactgtgcattatggtagcctaattcgacatactttctgcactcaggatatttattaatgtcataattcggtacagggaggagcttcgcccactcaacgcccaatgtctcgagcgctttcgcgaatgcattctggtgagcattgtcgcgtacaatcagaaaagcaagtgtttcgcggaacgtctgattagagctcatttcataaattcttgttttttgcagcacacctgtcgactcaagaagcagattatcaagcaggtcagtaattaagtttccgtggttatacacccacgacccgttccacggattgccccctgcatcaacgggaagggaactttgcgctccaataatataatgatgaggattagcatgtttaaccgcttcatcaagtggcgcttgatctgtaccttgactgccgacaccttcaccgcctgattcatctaataaagcattgattgtgttttgaaccagttcaacgtgggcaatctcctctaaaaaaatgccgcgaagcagatcgcggtactgtttctgctttcctctgaaattagagctttggaaaaaaaactgcatcattgtacgcatttctccgtaatgaccgcctaatatctcctgcaggaccttagcagctgccgggtctggcttgtccggtttaatgatattaatcagttcctctttgtagtaatacataacacgcctcatttcttcttaagagattttcttatattatttgtaagatgagataaaatatatacatgataagcatgggaaggcgtgaaagaagaaaataaaaaaatacaggaaaagtgttgaccaaataaaacaggcatggtatattattaaacgtcgctgatgaacagcgtgaaacaaaacgaaaaacaaaaaagtttttctaaggtgtttacaagattttaaaaatgtgtataataagaaaagtcgaattgaaaaacattcggaaaacatttttaaaaaacttcttgacttcaacatcaaatgatagtatgatagttaagtcgctcataagcgcccgtagctcaattggatagagcgtttgactacggatcaaaaggttaggggttcgactcctctcgggcgcgccatataagataccacgcgggtgtagtttagtggtaaaacctcagccttccaagctgatgtcgtgagttcgattctcatcacccgctccattattgaatgatctttgaaaactaaacaagacaaaacgtacctgttaattcagttttaaaaaatcgcacagcgatgtgcgtagtcagtcaaactagggcctgcacgacgcaggtcacacaggtgtcaccgcgggatgcggtgaacttaacctgtgatccatttatcggagagtttgatcctggctcaggacgaacgctggcggcgtgcctaatacatgcaagtnnnnnnnacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaacactctcaatttgtttggtggcgatagcgaagaggtcacacccgttcccataccgaacacggaagttaagctcttcagcgccgatggtagtcggggctttccccctgtgagagtaggacgtcgccaagcattacttttatcatcgcggggtggagcagttcggtagctcgtcgggctcataacccgaaggtcgcaggttcaaatcctgcccccgcaaccaaatatatgattaaataaggagtgccctaagggtacaactaaaataatcttatacaaatatggtccggtagttcagttggttagaatgcctgcctgtcacgcaggaggtcgcgggttcgagtcccgtccggaccgccattaatgtaaacgaaacgatcatgttttcgttttttttgtgttttcttttactgtatcttctgcttggtgtcatagccaagctttctttatatcgggaacatcttggatattccagcaaaattcgataaactaggaagagcacatataggcatatgcaggggtgaaaggagattttggttcatggatgaatttgatttgatacatagcattactccgcggaccattcaccattcttccgttgatgtaggaataggtgatgatgcagcgctctacactgcgaaacacggcgttcaggaaattgtttgtgttgatactatggtagaagacgtgcacttcaaattacactattcctcacctgaagatatcgggtacaaggcgttagccgttaatataagtgatattgccgcgatgggaggcattccgaaattttatttggtatcacttgcggtaccttcaaaatggacggcatccgaaatcaaggcaatgtatgaaggaatgaatgaactggcgaaactatatcagatggatctgattggtggcgatacagtttctaccgctgacaaattagtcgttacagtcactgtgatcggtgaaattgaaaagggacgtgcctgtttgcgcagtctggcaagaccgaatgatgttgtgtttgtaactggtgaaatcggttcttctgcagcaggactttctttattattagaggagactcatcctcaagattcttctattgacacggattactttatcaataggcataaacagcctgagccaagagtaagcgtcggcagattatgctcgagttttaaacgggcagctttaaatgatgttagtgacggattggctagtgaactgaacgagattgcagaagccagctgtgtttcaattgaaattgatgaaagcatgcttccaattcattctgatttacctaagcttcatcctaactggaaaggatgggctttgtttggcggtgaggattttgagctgacagggacggtttcaaaagaggagtgggaagtgttgaagcagcagtgcgcagcacgtcaacttcccattacaaagattggccatgtcagggaaaaaacaaaatctaaagtgatcctaaaaacagatcaaacatcaatgatcttagagaaaaagggatataatcattttaaataagacgggtgactcgtgtgaagcaattaaaatggagaactgtaaatccagaagaaacaaaagcaattgccaagcttgcggcagcgtttgctaaaccgggagacgtcctgacattagagggcgatttaggtgcaggaaaaacgacttttacgaaaggttttgcagaagggctgggaattacacgtgttgtaaacagtccgacttttacaattataaaagaatataacgatggcgtacttcctctttatcatatggatgtgtatagaatggaagatgaaagtgaagatttgggacttgatgaatattttcacggacaaggtgtctgtctcgttgaatgggctcatttaattgaagaacagctgccgcaggagcgactgcaaattgtcatcaaaagagctggtgatgatgagcgggaaattacctttactgctgtcgggaatcggtatgaaatgctttgtgaggagttaagtagacatgacaatattagcaattgatacatcaaattatacattgggcattgcgctgcttcgagaagacactattatagcagaatacattacatatctgaaaaagaaccactctgtaagagcgatgcctgccgttcattcattgctgaatgattgtgatatggcaccgcaggacctttctaaaattgtcgttgcaaaaggccctggttcatacacaggagtaagaataggtgtgacgttggccaaaacacttgcctggtctttagacattccaataagtgctgtatcaagtcttgagacgcttgcggcaaatggccggcattttgacggtctgatcagcccaatctttgatgctagacggggacaggtgtacacaggtctgtatcaatataaaaatggacttttagagcaagctgttccagatcaaaatgtgatgctggcagattggctggagatgctaaaagaaaaggatcgccctgttttgtttttaggtcacgacacttctattcacaagcagatgataaaggatgttcttagaacaaaaggattcattggaactgctgcccagcataacccgcgtccttcagaattggcttttctcgggaaggaaaaggtagcagctgatgttcatgggcttgtcccggattacttgcggctggcagaagctgaagcgaaatggattgaaagtcaaaagtagggtgataggatgaaaacaaaagcagcggtcagaaatatgcggcttgaagatatagatcacgtatacgaaatcgaagcatcctcctttacgtctccttggacgaaggattcgttttatcatgagctgctggaaaatccatatgctcattatctcgtgattgaaaaggacggccatgttgttgggtattgcgggatttggattgtgatggatgatgcccagattacaaatatagcgataaaaccagagtatcgcggccagtctttaggagaaacgctttttcgctcagctgttgaactgtgcaaagaaaaagacgcaaggcggctttcgcttgaagtgagggtttcgaatcatcctgctcaaggcttatataagaaattcgggatgcagcccggcggaataagaaagaactattatactgataacggggaagatgcgttaattatgtgggtgacgataaatgagtgagcaaaaagacatgtacgtattaggaattgaaacaagctgtgatgagactgctgcagctattgtgaaaaacgggaaagagatcatttcaaacgtagtagcctctcaaattgaaagccataagcgcttcggaggcgttgtgccggaaattgcttcaagacatcatgttgaacaaatcactttggttatagaagaggcgtttcgcaaagctggcatgacgtatagtgatattgatgcgattgcagtaacagaaggtccgggactggtgggagcgcttcttatcggagtgaatgccgctaaagcattgagctttgcccataacattccgttagtaggcgttcatcatatagccggtcatatatacgcgaaccgtcttgtagaagacatcgtgttcccggcactggcattggtcgtttcaggaggccatacagaactagtttatatgaaggaacatggatcatttgaagtcattggggaaacccttgatgatgcggcaggagaagcttacgacaaagtggcgcggacgatgggattgccatatccgggtggaccgcaaattgacaagctagctgaaaaagggaatgacaatattccgcttcctcgcgcatggcttgaagaaggctcttacaacttcagctttagcggattgaagtctgcggtgatcaatacgcttcataatgcatcccaaaaagggcaagagattgctcccgaagatttgtctgccagtttccaaaatagtgtgatcgatgtcttggtcaccaaaacggcgcgcgcggcaaaggaatatgatgtcaaacaggtccttttagccggaggagtagctgcaaacagaggcctcagagctgcattagaaaaggaatttgcccagcatgaagggattacgcttgtcattcctccattagctttatgcacggataatgctgcgatgattgctgctgctggtacaattgcttttgaaaaaggaattcgcggtgcgtatgatatgaatggccagcccggccttgaattgacttcttatcaaagtctcacgagataatagcgtgagactttttatctgtttgttattaacagataattcacaatttatccacatgtctgtgagtaattatagagatatagatggataaagggctgaagtcgctgttaataaagtggataaattcagaatattttgtggatattgtgtataaagcgcttactttgttttgcttattagggtatgttctgtggataaaaagcacctctaaaaagaggtgcttgacttttttaatcttcttctgtggatagttcttcccattcggacaaaagagattccagctcctgattgagcttctcattgtctgcatggatagcttgtactttttcatgatcctgatagacttcagggtcacatagcaattcatcattgcggctgatgttttcttcaatggtttgaacggtggtttcaatttcttcaatccgacggagtcgttggcgctctttctttttccattctttttcttcctcgtaggaaagtttggagtcagacttcactgtagctggcgttttatcagtttcctcttgctgattcattttctccaattcaagctgctctgtttttttctctgtataataatcgtaatctcccagatactcctctatatggcttgaagaaagctccaatactcttgtggcgattctgttaataaaatatctgtcatgtgagacaaataacagtgtgcctggataatcaatcagcgcgttttcgagaacttctttgctgtctaaatccagatggttcgtcggttcatcaaggatgagaaagttggctttttgaagcatcagcttagctagagccaatcttgctttttcgcctccgctcagtgaatgaactggtttcagcacatcatctccggagaataagaaatttccgagacacgttctgatttctttttctgggagcccggggtactcgtcccacagctcatcaaggacacgtttagaggaagtcaactcagcctgttcctggtcataatagccgacactgacatttgagccgtaagaaattgttccctgatctggttttagggtgtctattaatgttttcagcaatgtcgatttacctattccgttagggccgacaagcgcagcgctttctcctcttgtgagcataaatgacacttctgttaaaagcggcggctggttttcatagctgattgtgagatcctgaacacgaaggacttcatttccgctctgttttgtaatatcaaaatgaaagtttgcggatttttcatcgccaagcggttttgacatgacatccattcgctcaagctgctttctgcggctttgcgcccttttggtggtagaggctctcgccagatttcgatctacgaagtcctgcagctttgcaatctcgtcctgctgcttttcatacattttcagatctttttcatactgcgccgctttttggtcgagataagcgctgtagttgccgtgatactttttgctttctgctcttgatacctcgtatacctggtttactactttgtccaaaaagtagcggtcatgcgaaacgatgagaatggcgcctgaatagccttgcaaataatgttcaagccaggtaagcgtatcaatatccagatggtttgtcggctcatcgagaatgagcaaatcaggctgtgttaacagaagcttacctaaagccagtcttgttttctggcctccgctgaggctttgaacctgtgtagaatcgtcaaaatggctgaagccgagaccatgcagcacagatctaacatccgcttcatattgatagccgcctttatctttgaattcctgctgaaggcggtcgtaggttttcatgatgctctctaattcacccggggcagctgccgccattttttcttccatagcccgcatttccttttccattgcttttaagtggtcaaaaacagtcagcagctcttcttttatggtaagcttagaatccaagccagtatgctgggcgagatatcccattgtaatatctttcggtttaataatttcgcccttctcatacgaaagctggcctgcgataattttaaggagcgtggattttccggcgccatttcttcctacaatggcgatgcgatcacgatttctgacttccagctttatattgtttaaaatagtatcagcaccaaacgatttggacagctgattaatttgtaagatcatcatattatttcacctctgctataataagttaagtgtagcttatgaaccagaagtcagcaaacaatacattggccatataagacatagagaagaaaatagtgtatgatctgtttaaggagcgttttaatatgaatggattttctcattttaatgaacagggcagagcccagatggtggatattagcgaaaaatcttcaactgtccgtactgcggcggctgtttcaagcgtacacatgaagaatgaggtgtacgagaaaatacagagtcacgatatcggcaaaggagatgtactggctgtcgcacaggtggcaggcattatggccgcaaagcaaacgtcgaatatcattccgatgtgccatccgctttcattgagcggggtagatatatcgtttgactggaaaataaaagaagcagaagttatacttcatataaaagcacaggtcaaaacaaaagggagtacaggtgtggaaatggaagcgctcacttctgtatcggtgtgcgctcttaccgtttacgatatgtgcaaggctcttgataaggggatggtcatcggccctactttcttgctggagaagacaggcgggaaaaacggtgactttaaaagagaactatccgagtataatttggaggaccaaaaatgaataaggatcaatcaaaaattccgcaggcgacggcgaaacggctgccgctttactatcgctttttaaagaatctgcatgcgtcaggaaaacagcgtgtatcatccgctgaactcagtgatgccgtaaaggttgattctgccacgattcggagggatttttcctattttggagctcttggcaaaaaaggatacggatataatgtggattatttgctgtcttttttccgaaaaacgcttgatcaggatgagatgacagacgtcatcttgattggtgtcgggaacttgggaacggcatttcttcactataatttcacaaaaaataataacacaaaaatttctatggcttttgatataaatgagagtaaaataggaactgaggtaggcggcgtgcccgtctataaccttgatgaccttgaacaacacgtaaaagatgaatcagttgccattcttacagtgcctgcagttgccgctcaatccattacagacagattggtcgcattaggaatcaagggaatccttaattttacgccggcccgtttgaatgtgccggaacacattcgaattcatcatatagatttagcagttgagcttcagtcacttgtttattttttgaagcattattcagttttagaggaaatcgaatagagggaaaggaggagcccaaatatgccgatcggtcctggaagccttgctgttatcgcaatcgttgctctgattatcttcggtcccaaaaagctgcctgaattggggaaagcagcgggagacacacttcgtgaattcaaaaacgctactaaaggattaacgagtgatgaagaggaaaaaaagaaagaagatcagtaagttaggatgacacgaatgaaagtgaatcaaatgtcgctgctggagcatattgctgagcttcgaaaacggttgctgattgtagcgctggcgtttgtcgttttctttattgctggattttttttagcaaagccgattattgtgtacctgcaagaaacagatgaagcgaagcagcttacgcttaacgcgtttaacctgacagacccgctttatgtgtttatgcaatttgcatttatcatcggcatagtcttgacctcgccggttattctttatcagctttgggcttttgtgagcccgggcctctatgagaaagagcgcaaagtaacgctcagctacattccgatctctattttgctgtttttagcgggcttatctttttcatattatattttatttccttttgttgttgattttatgaagcgaatttctcaggacttgaatgtcaatcaggtgatcggaattaatgaatattttcattttcttctgcagctgacgattccgtttggactgctgttccaaatgccggtcatcctcatgtttttgaccaggctcggaattgtgacaccgatgttcttggcgaaaatcagaaagtatgcgtattttacgctgctggtgatcgcagccctgattacaccgcctgagcttctgtcccatatgatggtcacagtcccgcttttgattttatatgaaatcagtatccttatatcgaaggccgcttatcggaaagcacagaaaagcagtgcagccgatcgggacgtgtcttctgggcaataataaaaaatccatttctcatgcgagaaatggattttctttatttctggttctttttgattttaaatgaaaaggcgaacatcttaaaagaaatgctgatgttgtaagcggcgaacaccatcagcaggatggagtaaaatgaccacatgctgcctggcgagcttgcggcaagataagtaaagatgcaccctacggcaaagtagatcattccccaaactaccgggtttctcataaaaataatcctccaataatcaattgcatttgtgtgctctgctgttcaaggtaattccgaacaggctcaagctgcatgatgacgacgaatgtattcatcattaaatgggcgaaaatcggcacccatatccgttttgttctcgcatataaaaaggcaaaggtaaagcccattgctgtatatagaagaagatgcttcaaatcagcgtgaacaataccgaagataaccgagctgatcagtcctgcgaaaaagaaattcgttttttcgtacagcgcgccgaaaatgatttttctgaagatgatttcttctaatataggcccgacgatggaagaaacgataatcatgagcgggactgcctgaatgacatccagaatcgcttgtgtattttctgattctcttccgatgccaaaaacataatattcaatagagcctgctattccttgagagaaaagggcaatgaaaaaaccggctatcgcccaaaggatagaaagtccgattgagtccttctgtccgtttcgcagcgtttctttcggaacggttctcagaatgagcagaacaacaacgagacaggcgataaagctgataacggaccataatccttgtgcatgcagcatattttcatctgtaggctgtcctccggcataaccgaatttaaataacaagggaatcgcgattaatgcggaaaactgcatgatgatatatgtcaaaataataaaccaatactgttttctcaaatggtatgtactcctttgttaagtgggtttcgttcatctacagctattgtaacataatcggtacgggggtgaaaaagctaacggaaaagggagcggaaaagaatgatgtaagcgtgaaaaattttttatcttatcacttgaaattggaagggagattctttattataagaattgtgttagcactctttagtgctgagtgctaaaattacatattcatactattgaggaggttattacattgttaaagccattaggtgatcgcgttgtcattgaactcgtagaatctgaagaaaaaactgccagcggaattgtgttgccggattctgcaaaagaaaaaccgcaagaaggcaaaatcgtggcagctggttcaggtcgcgtgttagaaagcggagagcgcgttgctttagaagtaaaagagggcgaccgcattatcttctcaaaatacgcaggtactgaagtgaaatacgaaggtactgaatacttaatcttacgtgaaagcgacattttagctgttatcggctaattcttaaataaacaatacttaaaacatttgaggaggtcttgtaaacatggcaaaagaaattaagtttagtgaagaagctcgccgcgcaatgcttcgcggtgtcgatgcacttgctgatgctgttaaagtaactttaggaccaaaaggacgcaacgtggttctagagaaaaaattcggttctccgttaatcacaaatgacggtgtaacaatcgctaaagaaatcgagctagaagacgcgtttgaaaacatgggtgctaagcttgttgctgaagtagccagcaaaacaaacgacgttgccggtgacggtacaacaactgcaacagttcttgcgcaagcaatgatccgtgaaggccttaaaaacgtaacagcaggcgctaaccctgtaggcgtgcgtaaagggatggaacaagctgtagcggttgcgatcgaaaacttaaaagaaatttctaagccaatcgaaggcaaagagtctatcgctcaggttgctgcgatctctgctgctgatgaggaagtcggaagccttatcgctgaagcaatggagcgcgtaggaaacgacggcgttatcacaatcgaagagtctaaaggcttcacaactgagcttgaagttgttgaaggtatgcaattcgaccgcggatatgcgtctccttacatggtaactgactctgataagatggaagcggttcttgacaatccttacatcttaatcacagacaaaaaaatcacaaacattcaagaaatccttcctgtgcttgagcaggttgttcagcaaggcaaaccattgcttctgatcgcagaagacgttgaaggcgaagcacttgctacacttgttgtgaacaaacttcgcggcacattcaacgcagtggctgttaaagctcctggcttcggtgaccgccgtaaagcaatgcttgaagacatcgctgtccttactggcggagaagtcatcacagaagatcttggccttgacctgaaatctactcaaatcgctcaattgggacgcgcttctaaagttgtcgttactaaagaaaacacaacaatcgttgaaggcgctggcgaaacagacaaaatttctgcccgcgtgactcaaatccgcgctcaagtggaagaaacaacttctgaattcgacagagaaaaattacaagagcgtcttgctaaacttgctggcggcgtagctgtcatcaaagtcggcgctgcgactgaaactgaactgaaagagcgtaaacttcgcatcgaagacgccctgaactcaactcgcgcagctgttgaagaaggcatcgtatccggtggtggtacagcgcttgtaaacgtatataacaaagtcgctgcagttgaagctgaaggcgatgctcaaacaggtatcaacatcgtgcttcgcgcgcttgaagagccaatccgtcaaatcgcacataacgctggtcttgaaggatctgtcatcgttgagcgcctcaaaaacgaagaaatcggcgtaggcttcaacgctgcaactggcgaatgggtaaacatgatcgaaaaaggtatcgttgacccaacgaaagttacacgctcagctcttcaaaacgctgcgtctgtagctgcaatgttcttaacaactgaagccgttgtcgctgacaagccagaagaaaacgctggcggcggaatgcctgacatgggcggcatgagcggtatgggcggcatgatgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcggcatgatgtaaaaccgacaaaaaaaccttgatttacaaaggtttgtcggcaatggacgtcatttttgatgcccttttgatgccatttgtaaatttcgaggcttctcatgagttcaccgaacttgtgagaagcttcttttttnnnnnnnnnnnnnnnnnnnnnnnnnnnnnnnnnnnnnnnnnnnnnnnnnnnnnnnnnnnncttctctccctattgcagacaggagatggtatcctctcataagataaaaaagccccagttatctaaataaatagtgtcaccaacactcttagacgtttccccaaggaaaacattgtcaaaagaaatcctattaaaatgtctatttgtgctgctttttagctactaagacgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccaaggaggacttaatagtgcatttttcagaaatgatagatcgcttggctttatatgatttacacagaaaaagaagcaaagataaacatttttctgctgctattgcagccgatatcgatgatagagaggaattttacagtgcaaatatagctgatgtttcaattgacttgaatgaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatattgatcgtacaattgagtcgacaagacaggccattgtcgatttacgggcattaattcactggataaaagcaaataaaaaaggccctgttatcatagtgggggtaagcttagggggatgggttactaatctaattgcaaccctagaatcccaaattgatgtagtggtatcaatcttttatgccaatcgcctttcttattcaatatggaacacgatcccaggtaaattcataagagaagaattagaacaaaatggtgtgacctatgaagatttaacaaaatattggaatatcacagatcctagtcaagccttgccgaaagttaataaagataacattctgctgatttctgctaaacatgatcagtatattgacttaaaagatgcagattatttatgggaaagctgggggaaacccacaagatatgtctacaattgtggtcattccggtattgttctttgtcgcaaaaagctggcaaatgatacgctttcctttataagagaaaacctggttcagtacatttgtagaccttaataagaaacgaaaggccaactgcaacttcagttggcctttcctatttattgagtgagagtgctgacagaactacgtactactcgttttctttagtcacccttgccaaaagttccacctctccccgaatcccaatcgcaggctcccacgaatcaatcaaacgaagcgccttctgattagcttccatcgctttcgttttctctcctttacggtacaacagctgcgccattccgtagtgatagtagatcagttcaacttgattggcgttatgtttgtcatagagcatttgctcaaaggcttcttccgctttttcaaactgatcacatttcacgtaagcgacacccagattgaaataggcttctatcgttttttcgccgccgtatgtggagctgatttcatttgccgcttcgtataattgaatggcttctacatgataacctctcgcaaagcttaagtcaccgcgaaccaatagaactctgtgttgaatggtaggggaaatcggttgattttcgatttcgttttaaattgtctctgctttttcctgttgcccgtcttttaaaaacagccttgctttgagtgcatgtccccaaacctttagatcataggcatcgtgagcgtctgattgttcaagaatcttcagcccggcttctatttgctgaagcgctccgtctaaatcattgacttccatcaatgcccagcctgaggtgtcgattcggaagtacgcttctcgtgtgtgttggcctaagtgatgggcggcgtcggccgctttgcgtccgtattcgattcgcaggggcaggttgattctgcttagaaaatggctaatgcgggtgatgagttcgattaggatttctttttgttcagtttcacttgcccattggatgacctttaagatgtttggccattcttgtttcatttgatctaagttccgtcccagcaggtagctccaatagatagagttgggctgttcccgctttaaatgggtttcggcataatcaatataatagtgcgcccagcgattgcgggcttctttttcatattcgtgctgttcggacaagtgctgttctccgtaagcgacaacggtttggtgcgctaagtattgtgtcctgccttggcttcgttccggctgaatcagcgcatatgaccgcatttgttccatagcgtaatgaaaacggcgggcgtctaatccggctgctgccgccaggcttttttcatcaggcggcttgctgaaaaagcaaagcgtctgccagagctttcgcgtatcttcattgcatctatcccaggtgcggccaaagaggaattcaaacaattccagcagtgagtagcctgcttttccaagctcatgaatcagctgctgagcggggatgtcatcgtctgacatataggcgatgctgagtgccatggctttcgggtttccggcagtcgctgaaatgaattcgtttttcaggtcagatgatagatgtaacagctgctccagcttttcccgtttacgtgggaggttgcatgtttgtaagcagtgatgcacttcttgttgaaaaaattcgtgggcatctgtttggtcaagaccgcttagctgaatggctgtcatttctccgaagctttcccgataagtttgctttacgttttcccgcgctgtaaggagaacttttacgccttgcggaaggctggtgataaattcatgaatgtcacgttctgcagtatcaatgctgtcaacgatcagcaggatcggtttttctctagtgtaattggctaacgcattgcggacgacaaaccgttttacattgattgatttatcgatttgttctttgcgtccgagctgataggcgatcgtatttaaaaaatcgctaaagcttaatcctttccaatcagcgctgacccagatgatgctgttgaatgccggccaaactgaagtatcgtcgacacaggaataggcggcttcaagagcaattgtggtttttcccatgccggcccagccggtgattaaacagactggtgatggagaaagcatccattgccgtatcgcttccatatcaaagctgcgtccgataaagcgtccggaccagcgtgagggtaaattatgcgtgatgggctgttctgtaagcgcattcgtttcttggccgggtctgtcatgaaacagccgttttactacattttcaatttcgccttcactcggagccccgaataatccgtcttttcgcagtattttcgcttttttcaaacaggatgctgcccatacaggcaatgcgggtttgatgactgggatagtggtggcttccagcaagtcggtcaaccactcgatatccaagtcggtcttttcgagaatgatccagatcattccgaacagttttccgtcgtcgattcttccgggaatgtagtttgcccccatctgtccgatccagcttttgatcgtgtttggggagactcccagctggagtgcgattttatctatgtaagactgtcctgttttttcattctttttccttctgactttataatcaggatgaagttttagcgttttgacgccaggtgccagcatttgtgcaaattgttttcggttttcaagttcagccataagcctgcacctcctattagtactattttatcaatccagcgttttttgtatatgaaaaaataaaaggacagtgccgctgtccttttatacagcaggaaaggctgttgaacgtgttaaaaagcagataaaatgggggcagtaacagagaaaacaaaaatgtatgcacttacattttattttctaaagaaaggaacttgccaaatgactcacacagtacctcaaaacatgaaagcggctgttatgcacaacacaagagagatcaaaattgaaacattgcctgtgcctgatatcaatcatgatgaagtgttgattaaggtgatggctgtcggaatttgcggatctgatctgcattactatacaaatggccgaataggcaactatgttgtggaaaaaccatttatccttgggcatgaatgtgcgggtgaaattgccgctgtcggatcatctgtcgatcaattcaaggtgggagaccgcgtcgctgtagagccgggtgttacgtgcggacgctgtgaggcgtgcaaagaaggacgctataatctttgcccggatgtacagtttttggctacaccgccggtagacggtgcgtttgtccaatatattaaaatgcgtcaggactttgtttttttaatcccagactcactttcttatgaagaagctgctttgatcgaaccgttttctgtcggcattcatgcggccgcgagaacaaagcttcagcccggatcaacaattgcgattatgggaatggggcctgtaggattaatggctgttgccgcagctaaagcatttggggcaggcacaatcattgtcaccgacttagagccgctgcggttagaagctgcgaaaaaaatgggagcgactcatattattaatatacgtgaacaggatgcacttgaagagattaaaacgatcacgaatgatagaggcgttgatgttgcttgggaaacagcagggaatccagcggcattgcaatccgcactggcttctgtgcgccggggcggaaaattggcgattgtcggtttgccttcacagaacgagattccgctcaatgtgccgtttattgcggataacgagattgatatttacgggatcttccgttatgccaatacgtatccgaagggaatcgaatttctcgcttcaggcattgtggacacgaagcatctagtaacggaccaatattcgctggagcagacgcaagatgcgatggaacgggcgcttcaatttaagaatgaatgtttaaaagtgatggtgtatccaaatcgctgagtgaacagggaggatcttcgtattctccctcttgtttactggtaatgaaaacggattcttggggtgggaaatatgattgaaacagaaaaagtaacggcaatgaatgcgaagcgtcagtcaaaatccagtaccggactgtcctggtttgaacgaatcggttatggattcggcgatatgtcttataatattatctttcagtttgtaaacgcatacttattattttattatacagacgtcggcggcattcagcctgcggtgatcgcaactttgtttcttgttgtgcgtgtgctggatgctatttttgacccgatcatgggattgattttagataaaacgaatacaaggtggggaaaagcaaggccatatttgctgtgggtggcatttccttttgcgctattcacattcttatgtttcacgacacctcatttcggtgagacggggaatatggtatatgcgtatgtcacctatattctgcttgggatgtcctttagtatgcaaacgatcccggtgaacagcttaacggggcggatgacgaattctgtggaggagcgaacggttctgaccaccacccggatgattttggtgtatatcggcattcttttatccatttcctgtgcgacaccgcttgcaactactatcggaggggaggatcaggcgtttggatttcaaatgacggcgctcatctatgcggcagtcagcatcgttttgaatctatttagtttctttactgtacgggagcggattcagcctaaaaagagaaaaaaacaagggatcaaaaagacgttatccgttttattccgaaacaaacccttgcttatgttaatttcatcatttttggcttttgcgatcgggtttaatattaagctcagcacgatggtgtattattttacgtataacgtaaaccataaagagttcgtgtttatgggcaccgttttatttttcggggcagcgctgatcagcaatttgtttattcctttcttttctgagaagtggggcagaaaacaagtcatgatcatcacggcagctctatcgcttatttcttatgccggcctgcattttacgccgtattcttcaattccactcattttcatttggcttttcgcttcgggatttttcacaacgcctttaaatacgcttgcttggggaatggttgcggattgtgtcgattatgcggaatggaaaaccggaattcgcgcggatggtgtggtgatttcgagcatgagctttattaataagctgggtgttgcgttagccgggtcattttcggccatttatttaggaatcgccgggtatgtggcgaatacagaccagacagttgcgtcgttgaatgcgattaaaaatatgaatgctttgattccgggatttttcattttgctttctattattcttatcgccttctatcctttaacggaaaaaagatataaacacatcatctctgagctggagcaaaggtctgcgagataaatatatgtagaatttttaatattcaatgttgtatttatggcaaaaagtaatatactgagactgtaatctagactttataaatgagtgtgataatatgcgtagtcattctgtagtttgtattggggaattgttgattgatttcttttgtaccgatgttgacgttgatttaatggaagggcgccatttcctgaaaagtgccggcggggcaccggcgaatgtgtcggcagcgattgccaagctgggcggagacgccgctttcagcggaaaagtaggaaaggatccgtttgggtattttctgaagcgaacattggacgctgtacatgtcgatacctctatgctggtgatggatgagaaagcgcctacaacgcttgcttttgtttcattaaaacaaaatggagagcgtgactttgtttttaatagaggcgcggacgctttgtttacgctggaagatattgaccaggaaaaactaaacgaagcgaaaatccttcatttcggctctgcgacggcactgttatcggatccgttttgctcagcctatttacggctgatgtcgattgcgaaagacaatggacagtttatttcgtttgaccctaactaccgtgaagatttatggaggggaagagtctcagagtttgtaagtgttgcgaaaaaagcgatcgctgtaagtgattttgtgaaagtcagtgacgaggaacttgagattatcagcggtgtgaaggatcatgaaaagggagttgcgatccttcatgagatcggagccaacattgtcgctgtgacacttgggaaaagcggaacgcttctttccaatggaaaagaccgtgaaatcattccaagcattccggtgacatcaattgactcaacaggggcgggagatgcttttgtcggtgcggctttatatcaattggcaaacacggatcagattcaatctgtagatgctgattttgtgaaactgcgtgagattgtggcgtttgccaataaggtcggagctcttgtgtgcactaaaattggagcgattgatgcactgccgagtttggatgagattggagtttctttgtaaatcattgaagatgtttcttgaaagtctttggacttttgggggcatctttttttattgcttacatttttgttcaggtaaaaagttgtatattttttgtttgaaatgtcattttttattaaaaaagtgaaacttttaacgataataaatagtatatgtaacaagggttaccgaattagctttaggaggaacgatataatgagtataattggaagatttaaagatattatgtctgcgaatatcaatgctttattggacaaggctgaaaatccggagaaaatggtagatcaatatttaagaaatatgaatagcgatttggctaaggttaaggcagaaacagcagctgttatggctgaggagcagagagcaaaaagagaatatcacgaatgccaggcggatatggaaaagatggaaagctatgcaatgaaggcgctgcaagccgggaatgagagcgatgcgagaaaatttcttgaaagaaaaacatctttggagtcaaagctttctgagctgcaggcggcgaatcaaattgctgcaaccaatgccgcacagatgagaaagatgcatgacaaattggtatctgacattggagagctggaagcacgcaaaaatatgatcaaggcgaagtgggcagtagcgaaaacgcaagaaagaatgaacaaactgggcgcttctgtttcaagtacaagccaatcaatgtctgcattcggccgaatggaggacaaagtaaataaggcacttgatcaggccaatgcaatggctgaactgaacagcgctccgcaggatgatatggctgatctgtctgcaaagtatgacactggcggttcaagccaggttgatgatgaacttgcggcgttaaaagcgaaaatgatgctcgataagtaatacataggaggccgcagctttcggctgcggcgtcattttatcataaaatgtgagagggaacggtaatgataatatcttataagtgtccgaactgcggcagtgatatggcatttgacagtgaaaccggctcgttatcctgcagcagctgcggaagacaggacaatattgaaagccttccgaaagaaaacattgcggcacggttttctgatgatgaagcaaaagaatatcaatgtgaaaactgcggtgccgttttgatcacggaagctgaaacgacagcaacgacgtgcagcttctgcggaggtgctgcaatacttgccgatcgtttatcaggacatttggcgccggcgaaggtcattccatttacaatcagcaagcaagaagcggagcaggcatttcgaaagtggtgcaaaaaaggccttctgacaccaagaggtttcatgtctgctgatcgtatcaaaagcatcaccggcatgtatattccattttggatgtttgatttaaatagtgaagtacaggtgagagcaaactgtaccagagtccatcaatatgaagaaggggattatatttgcacggaaacagagcactttgaagcgtttcgtgatatcaatctcgattatttgaaaatccctgtcgatgcctctgaaaaaatgaaagacgaattaatggacaaattggagccttattcatacgaagagctgaaggactttcaaacggcatatttggccggttatattgcggaaaagtacaattataccgatgaggagctttttccgagggcaaaagagaaaatcagcagttatatagattcatacatccattctactttttccggatatacgtcagtcaatgtgagggacaaacatattcacacgaaaaacgtgaacagcttttacgttttgcttcctgtttggatggtcagttacgattatgaaagagcggagcatatctttgcgatgaacgggcaaacaggaaaggtcgttggaaagccgccgatcagtcgaggaaaagtggctgcatggtttagcggaatagcaggcgggacatttcttgcgttgaagctcgtctcattgatgatgggaggcggattttgatgcgtggattttttgggaaagcgatctttgttgtgctggctgttttcatcatgatgcctttactgggtatcgaagcggtaagagcctctgaattgcagcagcatgtgtacgatcgcgctcatctattgtcaaaagcggagatcggaaaacttgaatctctctcggcaaagctgggtgcaaagagggacactgatttcatcattattacgaccaaaagcacaaacggtgaagatattgcagactataccggcgatttttatgatcgttacggaaaaggcagtacagccattctgacgattgatatgacaaacagagaagtgtttatcgcaggctttaaaaaagccgaacagtatttggacaacagcaggctcaatagcatcagaaatacgatttcatctgatttatccaatgaaaattattttgaagcttttgagacatatattcagctttcctataaagatatgggcataaaaccgggagtaaaccctgacaacatattctttacatggtggtttcagctgattgctgccatcgcagtcgggggaattgcggtttcaatcatgctttatcatgcaggcggcaaagtaacggttaatggaaatacatatatggatcagcgtacgtctgatgtgattgatcaatacgacacttatattagaacgactgtaacaagagaaagaaaaccatcagataaagacagcggcagcgatggcggtgttacgaaaggcggcacgtcatacagtggaagccggggcagtttttaaatgtaagaaatagagaaagggagaggcgtaatgtcgtttttcagaaatcaattagcgaatgtagtagagtgggaagaatttagagatgatatgattttttataaatggaacaatcgtgaaatcaaaaaagggagccgtttaatcattcgtcccggacaggatgctgtctttttgaacaatgggcgggttgaaggagtctttcaagatgatggcgattatgatattgaatcagaaattattccattcctttcaacgttaaagggctttaagtttggctttaacagcggcatgcgagctgaggtgctgtttgtcaatacgaaggaatttaccgtaagatggggaacaaaacaggcgataaatattccggcagcgggaatgccaggcgggatgcccattcgcgcaaacggcacatttaatttcaaggtgcaggactatatcagcctgattgataaaatcgctggcgtgaaagatcaatattttgtagaggatattaaaacccgtatcatttctattctggatcagcttctcatgaagtggatcacaagagaagggaaagatatgtttaatcttcaagcaaacgcttttgatattgccaagggaattcaagaggacttagatatgcgcttaataagcgacgggatgacggtcactggttttcaaatcatgagctttaattatcctcaagaggttcaagaaatgattacaaagaacgcttcctacggtatggttggggatgtgaacagataccagcaaatatcaatgacggatggaatggcatccggaaagatgagcggaggcggagcggcttcggatatggctggaatgatgatgggaatgaatatggccaatcagatgatgaaccaaatgaatcaaaatcagcaggcacagtcatcaggcccacagtcaactggcagcggaagcaaaccgaatttctgtccaaactgcggaacaaaaacgggcgaagccaatttttgtccgaattgcggccagaagcttgtataagaatcatacagtgaaaagtccggagtgatcagacactccggacttttttatttaggagaataagcgttacctattgcttgctcctgaacaggccactttcgagcccccgcttggataattcccagcagcaattgacgacgttcctttattgaattgacggcaatttgaaatgtttgctttgataaagccggtatgcctgattgttgaagctttgagatgtctggttccggcggcgcttgttctgcaggatggatataggcagtatgaacggtatctagatagtttttgatacttgagcgcgcttctttgatatgaagctgattcggctgatattgttcaggaattccgtatttgaaaatggttagagcttcatccaatacagcaacagctataatggatgattcctgatgctgcgtgctgtggtaaaaatgaaggatggggaaggcgttatgctgagcggtcagctttcccagttctgatgaggcagcgacaagaagaaaatcaatgtcgtgaaaatctttgccattccatgcattatggacgatttctgttccgtcatgccctagacttaatacactttgggcaaaggagcgtttttgattaaccgcactcaagacggaaatcaaatacgtgacagaaaacgtgatggtaagcagtccttgagctgtttcaataatcgtgacaagcttccataggcctccgttcggagcgaggtcgccatttcctaatgtaaacatgacatagccggaaaaataaattcggtctgaccaggaagccagttcttttgattgagtttccataagtgagtgagggtcactcgagtaaatcaaaacccacccgccccaaaatagactgatccatatcactaacgtcaggcataacagcagaggaccagccatacttagaacctttgcgtggtcaccgctgattttgcggcagcccttccacagccaggcagacaggcatcttgtgatcgggcctgcaccgctctctaaccataacgtggtccataaaaaatcaatcatccccgctgtcaataataaaaggcctgcaatgatataaacctcattcattttggttgcctcccttaagccagccttcttttatttttcttttctatttccttttatcttgagtctgaaacaattgaacgaatgtttgattttacagagaaaaataggtgaagttacccaaaacttactcatttatcgatatgaatagaaaatcacaggatttttgacttgattcacacactttcatgaagaaaaacgtccattttccccttgaattggtgattttccttttatagagtaaaaaaatttcagaaatttatattgactgaaagcgtttttataattatgataatatcagatataacaaaaatgtcactatcatatcactacaattgaactatcaagtgactattaaatgccaaatttacaaggttatgcacaaagaaatgaccattgctcttttagcgagaaatgaaatcgcttccattgggactgacatgctaagaagaagggaaggttatgaggttattggataaaaacatgaataactattttctgaagcctgcttacgaaatgtgaggaaggcagcagccctggaataagtttttgacatacgcattttgaaaaagactgggggaaacagtatgaataaacaaggcaatcgaatgtcatttttacgtacaattattttagtctccacttttggcgggcttctttttggctatgataccggtgtgctcaatggagctttgccgtatatgggagagccggatcagcttaatctcaatgccttcacagagggccttgtcaccagttcacttctttttggagcggcactgggtgctgtgtttggcggcaggatgtctgattttaacggccgccgcaaaaatattttgttcctcgctgttatattttttatttcaacgattgggtgtacgtttgcaccaaatgttacggtcatgattatttcccgttttgtgctcggtattgcggttgggggtgcatccgtaacggtgcctgcctatttagcagagatgtctcctgtggaaagcaggggacggatggtgacgcagaacgaattgatgattgtatcaggacagcttttggcctttgtttttaatgcgatccttggaacaacaatgggagacaactcccatgtgtggaggtttatgctggtcattgcgtcacttccagccttgttcctgtttttcggcatgatcagaatgcccgagagtccccgttggcttgtttctaaaggaagaaaagaagatgctttgcgtgtattgaaaaaaatcagggacgaaaaacgggcagcagctgagctgcaagaaattgaattcgctttcaaaaaagaagaccagcttgaaaaagcgacatttaaagatctttcagtcccatgggtgcgccgtattgtgtttattggattagggattgcgattgtacagcaaattacaggtgtgaattcgattatgtattatgggactgaaattctaagaaattccggtttccaaacggaagccgctttaatcggaaatattgcgaatggcgtgatttcggtattggcaacattcgtcggaatctggctgctgggaagagtggggcgccggccgatgctgatgacaggcttgatcggtacgacaacagcattattgctaatcgggatattctcacttgtacttgaaggatcaccggcacttccgtatgtagtcctgtcattaacggtcacatttcttgcttttcagcagggcgccatttcaccagtgacttggctgatgctatctgaaattttcccgcttcgccttcgcggactgggaatgggtgttacggtattctgtctgtggatggtgaattttgcagtcagtttcacgtttccgatattgctggcagctatcgggctgtccacaacgttctttatcttcgttggattaggaatttgctctgtcttgtttgtgaagaggtttttgccggaaacgaaagggctttcgcttgagcagctggaggaaaacttccgcgcttatgatcacagcggggcaaagaaggattctggggctgaagtgattggataatttaaaaaagaatccgcacccgagtgcggattctttttggtttcaaattagttaggtctaacaaggattttgacttggcttttctctttaataagagccccgaagccttcctcgatcaaatcatctagtacgatttttttcgttacgagtttgtcggctgagaaatagccttctttcattaatgacaatacagccgggaagatgtcgcggtatccgataattccttttactgtacgttctttgattacgatatcgttcggatggatttcagcacctttttcccaaatgctgacgatgacggtttcaccggcaattgtagtggactggatggcttgtcgtaacaccactgggacaccagtgacttcgaatgctacgtcaacaccgcctcctgtacgttctgcaatctcagcgactacatcgtctgttttagacggatcaacgatgatcgcgccaagctcctcagctttttgctggcgttcaggagaaagctcaacagcgtaaatatcagttgcaccggcagccttcagcgcttcaatgacaagaagtccgatcgggccgcagccgaatacagccgctttgtcgcctgctttgagtttgcttgagcggacagcgtatagagcaactgcagaaggttcaacgagcgcgccttgttcatatgataattcatcaggaagtttgaacaaaagctcttcatctacagagacgtattcagagaaaccgccgcctccgccggctaagccgaggaatcccatttgttcatcaaggttgtaggcgccttggtggccgtgtgtagcaaaaatcggctcgactacgacgcggtctccaactttataattttcaacgccttctccgacttcgacaacttcaccggagaattcatgccccattgtgacaggtgccgtttcatttgttaatgggtgcggtttgtcaaccggaataaagatcgggccgcccagatattcgtgtaaatcacttccgcagatgccgcaccatttgactttgatctttacttttcccggctccgtttttggctcttcgatatgttcaatacggatatccttttggttatgccatcttgctgccttcatggattaccactcctataacttttgatgtgagtaattccgcaccggtcaatatgaactgttcacaaaatcgccatttttaaaaccaaaaaagaaatgaaatttttatataatataatctacgtttttttgaaaaaagaaactttaaagaaaaaagggtctcgcacactcttttttctttatatgagagtatcaatcgtttacatagctatgaatttggtttgaacaatacggtaatggttcgttcatattgaatgcgacaactactctatcaataattataacgctaataccgctattataataggataatcttccatggtttaatttagcagaggtaactttttgactttgtaacattactgtaaggatattgaaataaaaaatagctggttgatcgtgtataatcttcctagatgttaacaaacagggggacgaaatgttgaagaaagtcattttagccgcttttatcttagtaggaagtactttgggagcttttagtttttcatcagatgccagtgcgaaacatgtgaacggaaatattacttggtataacggagtcgggaaaaaaggctcttcaggtaagaaacttggacattgggattgtgcgaccaaaatcggatttgatgttcctagaaacgggacaaaaatcagagcttatgcaaaagcgaagcctaaaaaggtgattacggtttataaaaatgatgttggcagaatgcctaatgcagtgctggatgttagccctaaagcgtttaaagcgcttggatacccattaagcaaagggaaagtagcggggcattacagctattaatgtacatatataatctggaaagcaagaagtcacattcttgctttttctattggtggagataaaagatgaaaaaaagaatcatattattattagcagtgataatagcggcagctgccgcgggggttgcgttttatgttgcaaaggataaaggccatgagaaggctgctgatgtttcagtcaatactgaaagcggtgatgagctgctggtttcaattacagatacggatctgctgacaaagtattatgaaaatgacaaggtgatccatgaggagaagctgaccagctatccggcatttgccttggatcaaaaacagcaggtgctctattatacgggcaataatgaacagaatgaaatgaggctttttaaactggatctaaagtctaataaaaagacggtgctttataaaggcgcggagagtgcggacagtttgtttttatcaaaggaccgttcaaccatctatttccgcttaggaaaatcggacgaaagcaattttcggatcgccgcttttgatctgaaaacgaaaaagtacaaaaatctttatcctgccgctaatgatcaggataacaccgtcagcagcttcttttataaccaaaaaaacgattcatttgcattgcttcattattctgtagaagaagactacaagaaaacagatgaagcaaacgaaaagggcatcgacccagaaccgacaacgattcattttgcggaaggccgccaacataaatttaatgagctgaaaagcctgaaccaatttatcagcgatattgctgtttctgatgatgataaacgtattttattcacatcatatacgcagaaaggaacggagcaaaccgcttctattcagatgctcaatgcggatacgaaaaagtatgaaagcatcatctcaaatcaaaaatcatttaagctgttaattgacgcacagcctcagttctctaaggatggaaagaacatttattttcttgccgaagccaagggggctaaaaaactgaaggatgaaacagggcgtgaagctaaggtgcggacgatttattcctatagccttgaaaataagaccttcaaaaaagtatgggaaaatccgaacggcatcatcaacagcttttctgtgataaactaataaaaaccactcggcataagctgagtggcttttttaatggatgaggtgcagggctaatgatccgagccatttaaagatatgaatcagaggtactgacaaaaacagaagttcaacatatgagttcattgcaacattcagctttttgaacgcagctctttttttcaagtctttttgctgctggtttgagatcacgttatcactcctcttatatccatattataccattgaaacagacaaaaaagccctaaacgtttacagttttgggcttctttcttcgtatttggcctcttgcaatgagaggcttttattctgaaatatagaattttgtctccgttcggggtttgtttgcttgcgggagactgcatttgttatagggaagaactagcttgttttcgtttggctgttgttttggagattcactaatgaacggatgccgtcgaccattttacttccgcacaaagggcacaatggcgtatcactgctggcgaagttttttcgggtccagccattacagtcttcttttgtgcattcccaagtactcacatcttcttttggcagcggttcttgatttcgtttgttatagtaagacataaagtcacttcttccctcatgtattttactgcacattccttattgtctcatacttttccctaatctcctaattcctttttctttatgactttccaataaccccatctaaaaaggagaggagtgtgctgttaaaagcatctggctcttctaaaaacgggcaatggctgcttttagaaaaggtaacgagtgtcgcgttcggaatattgctgcgcaagtgttccccggctgctgtagagaaaaatttcttgtcttccccgaagcacagcaatgtcggcacattgatgttttggagggtgccccggtaatcagcggccgtttggttaaataaaatcgtgctagaaatggcagccggctgtttgaggatttctgccagcatccattctgtttcggtctcggcaggcggttctgcgaacatgttctggatgaagctttcgtagaaaggcagcgggtcagtttgaatggcgtgcatcgctgtttttaagccgtcaaaatcaaatggaccgtgttcccagccctcccattgatagtcggaagcggattgatcgatgatcacagcggcttgaatgttatcattcccaaattgattgagataatcccatacgacaaaagcgcccattgaccagccggcaagaacgacatggtcaagctccattgcatttagaaattcccttatgtcacgggcatattgggaaatggtgtggccgtgaagcactttgtcagattcgccgtgtcctctaagatcaagacgaatacattgataattggcagaaagcgccgaaaattgtttgtggaaaaattgtccgctcatcagcaccccatgtataaacaggatcggcgtcccgttcccgtgtgttacatagtaaaggcgtgtctgatcttctaatgtgatgtatggcatgtttctcctcctttagtttccatcatgagtatggctggctgctgttgagctgatgatggcagctgtcgcggctgcctgctgtgcttgaatgactgtttcgatagcggtgtatagtcctgattccatcagcagatttttctccatatgctcactgagatagaggctgacagcaattttaaagttcatttccttttgccatttaaaagctttttcctggtttaattcgtcagtgatgcacaaaacggttttgatatctggctcttccagaaatgtgaggagagcaaggtctggataatgataatcctttggttttttgacatcagtgatcgattgatatatctgtttgcaagcggaaacaagcatttcgggctctttttcactttgcaaggccagaatatggctgacctgatgtaagtactgtccttttttaaagccgttggctgccagcagttgatagcatgtttccgccttctgtagcgcctgcaaaccttttccgttttctccaagcagtatggcgagcggaacattctgagttgaagtgaggaaataatgatttttcttcatctgctgataaactgctagccccatgttcatctgttctttttggtttgtcgtttcagatttgccggtgagcaagatcagagtggaaaggtatgtgaacatatcccgcttatatcctagcttcaccatttcattgtatacatcgataaaagtatgaaatgtttgttttgcctcatgctgaaaatgaatgtccagaatagatgcaacagtaaagcggtggtgtgaattgagtgttgagaagctgccgatgtttgatttgatatagctgctcaaatcataaaagcgctgaaaatcaaactctcttttattcacaatatatgcagaagaaatgagcattaatatctgatcgtgtgaaactttccattttaattttgattttaattcagcataaatggaaatgtattgctttattttttcatgtaggtcgtgtgtcagcataaaaagcagctcctttttgctgtttttacgtaatacgataaatagggccaaaggtttcataaggaaaaaacttgcctgctagaggcaagtttgtcgggttatttatggggatctgttatatccatcggtctcatcatgtcatagtcttcatgctctagaatatggcaatgccatacgtatcgtccgctgtacggaccgaatgtcgccgcgattctcaggacttcacctgcatgcgcttgaatggtgtctttccagcccttttcacttggcggcggcgggacagccggaccggtataggacaattccccgctttcttgataacgggcgatatcaaacggccgccggtctaatacacggaaggagactagatgcaggtgaatcggatgtgttccgcgtgtcgggttgataatggaccatatttcagttgtgcccacttttggtgcttctgtgacgggatcgtgccagcgtttgttattaagcagaaggacgggtctgccgtattcgtcctgggtgcctgccagttttaacgttctgatgttttgtattctttcatgctgtaccgaagggtatgaggcgaggtacttcggctttctgctttcgtctttttgtgccaatggttttgtgactctgaattgcatgatattcgcatctgtttcaggattgacgtcaccgccgcagcccgcgctgtttgccaaaatgatcgattctccttcatatgctgtgaagtcaatgatgatatcataacgttcagcaggcgcaaggctgaaagaattcagtttaacagatcgcggcaggagccctccatctgaaccaatctgaataaactctccgccattatcgagtgacaggttataggttcttgtattggaggcgttgatgacacggaatcggtatttcctcggctcgacttccaagtatggccataccttcccgttgacgagtatggtttctccgcaaaaagccggaacgattgaaggattaggcagtgacggagaagggttttccggtgcgctcggataaaacaaagaaccgtcctcattgatcgtgcggtctgtgataagaagcggcacatcgtattcgtctgaaggcagttttaagcgtttttcctttgggtcatgaatgatataagcaccgacaagtccggcatagacatttagcctggtgagcgccatggcgtgatcgtggtaccacaatatagccccgcgctgctggtttggataatgataaacctctcttttgaaataaggtcctgtttgttcaaagtctttggaaaaccaagcctccggatacccgtcactatcatctggcgtgacgccgccgtgtaaatgaacaacagtctttacctcgggctcttcatgctggctgtcactgtgatgaatggtgtgatcaattggaaggaaatgcgtggaaggaaggttattcatccattttacatatacgttttcatttcttttaacctcaatggtcggccccggaaataagccgttgtagccccacaggcgggttggagggagatcgcgatggagctgatgagtgcattcctccatggtgacttcgtagtatgttttttcttttgattgctgtactggctttagtgtatctgggattgggagagcatccacaaatttttcaagtgtcattttcatctgtccttatctaaattttccaaattggtactatagttaatgacaataaggacgtgatggttacaaaaaatcttcgtgctgcagaccacccgaagaagaaaataacaaaatcctaaacggcaggccgtttaggatttgatcagcattaaggcaggatatcgggttgctgctgtgtgactgggttggcagccgctttctcgctcaccttgcgttttctgaacacaaggtaagaaatcagaacgattcccgtgatgacgcctgttagcagcagctcgtctctcatggaatcaataaacgccatggacactaaaattccgcaaatggcgatgatggtcaagtaggttaggaaagggaagagccacattttgatcttcaatgcttctgggtttgttttttcgagttttttccgcattttcagctgggaaactgcgatgacaagatagacgagtaaagcgattgcgcctgatgagttgactaagaataaaaagacggtatccggtgaaaaatagttcattacgaccgcgatataagagaaaaatgtcccggccacaatggcttgtacgggaacgccttttttgctcaatttcataaaacggcgcggcgcttcgtttctttctgcaagagaatacagcattctggatgtggtatacaaacctgaattcaggcaagagagtacggctgtgaggacgataaagttcataatctgtgcggctgcgggcactcctatatgctcaagtacagcgacgaaagggctttctaaaatatttgctgaattccatggcaacagcgctacgacaatggcgattgagcccacgtaaaagacgatgatgcgccatacaacggatctggtggcttttgtcacagattcgatcggattggatgtttcccctgctgcaatggcaacgatttcagttcccataaaagagaaaatgacaacgacaatgccgagcaatacggagctgatgccctccgggaaaaatccgcctttgcctgtaagattcgaaaaaccgactggctcactgcccggtgcaaagccaaaaataaaggcaaaaccaacgattagaaaagcaatgatagtcacaactttaatgagggagaaccaatattcaaactcaccgaaagacttaacggagtagacgtttgtcagggtgagcacaatggtcaagatcaaacttgtcagccacagcggaatatcatggaaccagtattgaataatgccagcaccggcaatggcttcgatcgctatgacgatcacccagaaaaaccagtacagccagccgattgtaaatcctgcccacggtccgatggcgtcgtgagcgtattgagaaaacgatccgctcgtcgggtttacggcagacatctcaccgagcattctcataataaaaatcaccaataatccggctaacgcgtaagaaacaacggcacccggaccggtcgagtgaatcactgaaccgctgcctacaaataggccggctccgattacaccggcaatcgaaatcattgtcatatggcgggtctttaattccttttttaatcctgattgagactggttcataagttacctccttttaaaatgcaatcattactgaatattatgataattgaaactctatcataaatatacagtttgtcgaaaattcgtgtaagaaaatataccagcttatttcaaatttgtagtgttttgtttgcgctttcagcgaatgtgtggaaaaaatgtttcgttttttattcgctgtgtgattttgcgtaatatttacaattcgatagaatgcgagaagcgctggtgtccttgggtttgatgggatttttggcggagcaaataaattggatgagagaaaaagtgttccttcgtcactatttttctgtggcgggtgaatcatgtttctgtagacccactgcggatcagctttgtaagataataataggaaaatgtgagcgagaggaggttttgtatggagagatatgatgaactgaaaaagggagaatccggagcgctggtcagcattgccgcgtatctagttctttccgcaattaaactgatcatcggttatctttttcactcggaagcacttacggcagacgggttaaataacacaactgacattattgcttctgttgctgtgctgattggcctgcgcatctctcaaaagcctcctgacgaagatcatccatacggccactttcgagcggaaacgattgcatcgcttatcgcatcgtttattatgatggttgtcggactgcaagtgctgttcagcgccggagaatctattttttctgctaaacaagagacgccggatatgattgcggcttggacggcagcgggcggggcagtcctgatgctgatcgtttaccggtacaataaaaggctggccaaaaaggtgaagagccaggcgctccttgctgcggctgctgataataaatcagacgcattcgtcagtatcggcacatttatcggcattgtggctgctcaattccatcttgcttggattgatacggtcactgcgtttgtgatcggtctgcttatttgcaagaccgcatgggatatttttaaagagtcatctcactctttgacagatggattcgacataaaggacatttccgcttataaacagacaatcgaaaaaatctccggtgtgagccgtttaaaagacataaaagcaagatacttgggcagcacggttcatgttgatgtggtggttgaggtatcggcagatttaaatattacggaaagccacgatatagccaatgaaattgagcggagaatgaaggaggagcatgcgattgattattcgcatgttcatatggagcctttagaacaaaaataatggagcttcctgtcacaggaagcttcagcgtgtcgacaaaccctcgcattcgttgtcaggtctgcgcttcggtgctcacgaattagaacattcgctccgctcctatgctcgtccttcctagacttcaagggttttcaatcacgctgaaaagatgacaaaaccctaaaatgaaagccattttaggattttgtcaacaatctggagcttcctgccacaggaagcttttttgtgtgttttggccagctttattggtaacaatttgctagaatcgtttttttatacagattgctttttgtggtaaagttaggttacattatgatgaattttgtagatgactaggaggaaaataatggcatatcaagaagacctgcatcctttgctggggaaagcagttgaacatattaatagagtaatggttggaaaacgagacatcgccatactcagcttagcagcccttcttgccaaagggcatgtgctgcttgaggatgtacccggagtcggaaaaacgatgatggtccgcgcgctggcaaagtcaatcggcgccgatttcaaaagaatccaattcactccggatttgctgccatctgatgtaacaggggtatctatctataatgcgaaaacgatggaatttgaatatcgtcccggcccaattatgggaaatatcgtgctggcagatgaaatcaaccgtacctctccgaagacacagtcggctttgctcgaagcgatggaagaggggagcgtcacggtagatggccatacgatgcagcttgccgatccgttttttgtgatggcaacgcaaaacccggtcgaatatgaagggacctatcctttgccggaagctcagcttgaccgttttttattcaaacttcggatgggttatccgtcctttaatgaagagcttgacgtcttatctcttcaggaaaaaagccatccgattgagacgcttgagccggttattgcaaaagaagacttcatctgtttacagagggaagtgcaaaatgtccgtgctgatgacagcattaaggaatatatcgttgaaattgtgcagaaaacgagacagcatccttctgttcaattaggcgtcagtccgcgcggctcaatcgccctcatgaaagcggcacaggcatacgcgctgctgcatcatcgcgactatgtcataccggatgatattcaatatttagctcctttcacgctgccgcaccggatgatgcttcattctgaggcaaaatttgaagggattcaggcagaagcgatcgtaagggagatcatgtcagctgtgaaggtgccggttcaaaggtcgtcggtccgctgatgaataagaaatggcaatggctcgtatatggttggaagctgattatattaattttattgacggctgctgttttttcttatgcgatgtttcagggcggctttgtcagctggtttttgttttacgcgtttctcccttttgtcttgtatgccgggctgctggccttgtatccgctccgttcttttcaggcttcaaggcaaatggatagaacacaattacatgcgggggacaggctgggcgtaacggttacgctgagaagaaagctgccatttcccctgatgtatatggtgattgaagattgcctgccagaaggtatcgagtcattaaatcgagacggagccgcggccaaacggctcgtttttccttggtttaaacggagcatgacgatgtcgtatgaattagctcgggtaccgcgcggagagcatcactttcattctgtcagggtgcgaaccggggatgttcttggcttgattgaaaaaacagcattttttgagctgaatgataccttgtttgtttatccattctatcagcgtttttcctatcaggtgaatgagaggcatcaggaagacggtgtaagcggttcttctcctattcatcagcaccattcctcagtcgcagcaagtgtgcggaattatcagccgggagaccggtttgctgcgttagattggaagacctctgcacggcggagccagctgatgacgaaggaatttgagccttctcgcagcaaaaatctgtttctgctgatggaccgtttttcctcagacgcattcgaagaggtcgtttcagtgacagcttcgattcttcattctgttttaaaaaacggcgcgggtgctggtctggcttccatcgggaaggaaaaaaacattttccctattcaggaaggggatcagcattttaagcacatgcttcggcatttagccatcgctcattgtgatgcggcagacccgataagccgatatgcacgggaagagctgggaaagccatctgttcgccaagctgatcaagttgttgtcacgggacagttaacggaagatatgctgcacctcgcagaaataggaggcggccgggttacggtgatactggcaaaagagaaagatgctgagctctctcaagctgaaaatgtcatgattgaacgcatgatgaaacgccaaatcagagttcgggtcatgaggggcgggcgagtttcgcgtgttgtttagaaagagaggtgactggttcacatgccgcacgatgatcacaagggaagccgtttgagcttgctgttattttattttctggcttttttattgctgtgggagtggctcaggccgcttgacagttttactgaaacgaaacatacaggcttttttagtgtctttatcggtttgacgtttctgctgacttttttcaggatgaggtggtttgtcaccgttcctttttgtgtcatatttacattgatctcgatacacatcctgttttatcaaggatctatattcgacttgagctgggtcagctcttttttgcaggatgtctatttgaatatcacgctgattcaatcagggcaatggaatgacatgattccttcttttcggaccctgctgttttttgtgctgctgtggctgctggtctatctcctgcattattgggtgatttaccagagaagaattttgtttttctttatgatgacagtagcgtatattacgattcttgatacctttacgccatatgatgccacttttgccgtcatccgtatcgtgctgatcggcttctttatgctgggccttttatacttggagcgcattaagctgatggaaagaatcacactgccaaaaacatctgtcctcaaatggtttcttcctttatctgtattggttttggctgcaacgggattcggactcgccgctccaaaatcagatccagcctggcctgatccggtgccttttcttaaaaaaatcactcatcaagaccgcgtgtctgcaggggaaagcaaaatcggatacgggaatcatgatgaatcactcggcggcccgttccagcaggatgctacacctgtttttacatggcagggaaaagagcgtacgtatttccgtgtggaaacgaaggacacgtataccggaaaaggctggattgaaacagacacaggcatgtcgtatcagcttagcagaggaaaagttgaaaatctgtggtttgaccataaagttgcgacagagcgccgcaccgtccgtgtaaaagtcgacaagcactacgggtataaccatctgatgtatccgattggtgtggaaaccattcagccaaagcaggctgtctcacttgaaatgaacggcaacacggagcaaatttctccgatcagtgaacaagccggtgaaatcagaaatatggggaattatactgtaacgtacaattccccggtttataagctggatgaactgagaaaggtaaaagtgagaaaaaacagtgaggagtacacattcagcgatcgctacatgcagcttccagattcactgccagagcgggtgagaacccttgcgatcaaactgactcaggatcacgacaatatgtttgataaggtgaaagcggttgaggactatttagggtcaaatgcgttcacctatgaaacagaaaacgtgaccattcctaagaatgatgaagattatgtcgatcaatttctctttgaaacgaaaatgggttattgtgataacttttcttccgccatggtggtgctcttgcgctcggccggcattccggcccgctgggtaaagggttatacgtccggtgaatacaaagaagcaggaaacaaaaatggcagcatctacgaagtgacaaataacaatgcccattcctgggtagaggtgtatttcccggaacagggctgggttacatttgagccgactaaagggtttacaaatccggctgaatttacttcttctgacacaaaggactccggcagcgataaaagcagctcgccgaagaaagcaaaagagaaacagaaagaagagaaaaaacagccgcaaaaagaggaaaaacaaaaggaaaagcgggagccagctgtttctaaaaagccgtccgcttcacataccaatgccggtgcgggcttgtatgcagcgcttgcgattcttgcagtcctcctggtggcagctgtattgctgtatgttttccgctcgttatggattcctgttttcgccgtgaggaaattgaagcggcgcaacgatcagcacgcgttttttgaggcatatgacgcgctgctgaaacaactgaagagaaaagggctgccgaaacgaggcagtgaaacgctgcgtgattatgcaaaacgaatcgatgaaaaatacgacatagaagacatgtcaaagctgacattaagctatgaaagggcgctttacagaaatgaagattcttcagcgctttggaatgattccagagagttatgggaaaatttaattaaaagaagatggtcttgaccgcttatcaacgtgttgttagaattagtgaatattatcggagtctgggagcgagttggcctgactccggcaaacggccttgccaaagagggcggagcgagcttcatatctgtcctcgtttttttctgtgtcaaaaaacttagaggagattaggtgacaaccatgacaaagttagtgaatgaaatgattcttgtccttgatttcggcagtcagtataaccagctgattacacgccgtatccgtgaattcggtgtttacagcgagctgcatccacatacattgacggctgaagaaattaaaaaaatgaatccaaaaggaattattttatccggcggtccaaacagtgtgtatgatgaaaactctttccgctgtgacgagaaaatcttcgagcttgatattcctgttttgggaatttgctacggcatgcagctgatgactcattaccttggcggtaaagttgaagcggcaagccagcgtgaatacggaaaagcaaacatccgcatcgaaggtacacctgatttgttcaaagatcttccaaacgaacaagtggtttggatgagccacggcgatttggttgtagaagttcctgaaggcttcactgttgacgcgacaagccatcactgcccgaactcagcgatgagcaaagcggacaaaaaatggtatggcgttcagttccacccggaagtgcgccactctgaatacggcaatgatcttctgaaaaactttgtattcggtgtttgcgaatgcgaaggcgaatggtcaatggagaactttatcgaaatcgaaatgcaaaaaatccgtgaaacggtcggagacaaacaggttctttgcgcgctaagcggcggcgttgattcctctgttgttgctgttttgattcataaagcgatcggcgaccagctgacttgtatctttgtagaccatggtcttctccgtaaaggcgaagctgagggtgttatgaaaacattcagcgaaggctttaacatgaatgtgattaaagtagacgcaaaagatcgattcttaaacaaactaaaaggcgtttctgatcctgagcaaaaacgcaaaatcatcggtaatgaattcatttacgtgtttgatgatgaagcggacaagctcaaaggcatcgactaccttgcacaaggaacgctttacacagatatcatcgagagcggtacagcaacggcgcaaacgatcaaatctcaccacaatgtcggcgggcttcctgaagacatgcagtttgagctgatcgagccgttaaacacgctcttcaaagacgaagtgcgcgcgctaggcacagagctcggcattccggatgaaatcgtatggcgtcagccgttcccaggaccgggcctcggaatccgtgttcttggcgaagtaacagaagaaaaacttgaaatcgttcgtgaatcagatgcaatcttgcgtgaagaaattgcaaatcacggcttagagcgtgatatctggcaatacttcactgttcttcctgacatccgcagcgttggtgttatgggtgacgcaagaacatatgattacacaatcggaatccgtgccgttacatcaatagacggcatgacatcagactgggcacgtatcccgtgggatgtgcttgaagtcatttcgacacgtatcgtaaacgaagtgaagcacattaaccgcgtggtgtacgatattacaagtaagccgcctgcgacgattgagtgggaataagaannnnnnnnnnnnnnnnnnnnnnnnnnnnnnnnnnnnnnnnnnnnnnnnnnnnnnnnnnnnnnnnnnnnnnnnnnnnnnnnnnnnnnntaatgttcgttgtttatattgtcaattcaaaatgaacttggtacaatagacacagaaatcaaataagatgaattcgtataatcgcgggaatatggctcgcaagtctctaccaagctaccgtaaatggcttgactacgtaaacatttctttcgtttgatataaataaaacacgtttatttattcaaactgaaatccgtctgtagtcaagcgtcccaaaattattggggcgttttttatttggcgatttcaggacagaataaatagcaaagagtgaagggagtcaaatagcttgaaaaagtattttcagtttgatgagctgggcaccagctatcgcaatgaaatcattggcggattaacgacttttttatctatggcatatattttgttcgtcaacccgattacgcttgctttggacagcgtgaaagattttccggaggcgctgagaattgaccagggtgcggtctttacggcgacagcgctggcgtctgcagcaggctgtatcttaatgggattaatagcgagatatccgattgccatcgcgccgggtatggggctgaacgcgttttttgcgttttctgttgtccttggtatgggtatttcatggcaggcagctttgtctggtgtttttatttcaggccttattttcgttgctctttctttaacaggttttcgtgaaaaaatcatcaacgccattccgcctgagctgaaattggcagtcggtgcggggatcggcctgtttattacattcgttggtttgcaaggctcaggaatcattactgcaaatccttctacgctcgtcacgatcggaaacattcacagcggtcctgtgctgttaacgattttcggtgtgattgtcacggttatattaatggtgcttcgcgtgaacgcaggcgtgtttatcgggatgctgttaacagcggttgccggcatgattttcggtttggttccggttccgactcaaattgtcggcagtgtgccgagccttgcgccgactttcggacaagcgtggattcacctcccggatattttctccgtacaaatgctgatcgttattttaacattcttgtttgtcggattttttgatacagctggtacacttgttgctgtggcgacacaagctggtttaatgaaggaaaacaaattgccgcgtgcgggccgtgcgcttttagctgattcatcttctattgtgatcggtgccgtgcttggtacgtctacaacaacttcttacgtggaatcaagctcaggtgtcgctgcgggtgcccgttcaggatttgccgcaattgtaacagggattctctttttactggctacgtttttctctccgctcctatcagtcgttacgtcaaatgtaacagcgccggcgcttattattgttggtgcattgatggtggcgccgcttggcaaaatcgcttgggataagttcgaagtggccgttcctgctttccttaccatgatcatgatgccgttaacgtacagcatcgcgactggtattgccatcggatttattttctatccgattacaatggtgtgcaaagggaaagcaaaagaggttcatccaatcatgtacgggctgtttgtcgtatttatcctgtactttatcttcttaaaataaggtatgaaaaaccagctgcaccggcagctggtttttttgttgcaaaagataaaaccatttcatacgatataccgtcatgtagatgtgccgccatgctttacttaaatggaaatgacttgactgttcaggaaggcttcggtaccttatataagtgttttattttcttgctgaatggtattccgccgtatttttttgataggagttgctgacatgacggaagaaagaaaagaaacgtttgaagaagaaattaaccagagtgaaagaatagatgcagatgaagaaccgctatcgagaatgtccagaaaggcgagccggcaaagcaagcagaagcaaaaacaaaagcagaaaccgcgccaggaacgcggtgaatcaactgttaaagacaagcttgcgtctgtttgggcagccatcaacagatattgcggttttgcgttctcgattttaaaatctccggcgaaaactgtcgtaacggatggtttttctcattataagtacggtctgatttcaatgcttatattcagtatcattttttcaattgggaattggtttcagttaaaggcaagctggaatcggccgctcggtttcggagaacgccatcatgctttctatgacgggtttttagttgttcttgtgtatttgctgatctttttcgcggtaatggtctttgctatatgggctgtctcccgctatatgatgaagcagaaggtgacgttcagagaagcggctgccgtattgggttcattgcttgtacccgtaattgctgtttcaatcctttggctgatctttgcgatcgtaaatatcccaatgctgacagtactgtttacggtgctgatcttgttttccatcttttttatcatcgcgctgtatgtacagcgtgtgtaccaggcggcacaagatgcatcaattgattatatctattgtgtatttgcagtggttgcgatagcgctgctgtttacggcagtgacttggccgtttatttcggaatattttacggcgtcgctgattccgctttaatgaaaaaaccggctaatcctagccggtttttttatgtcacactttttacaaatatatctaaaaaacatagttgatttgtaggattaacccgtgtatgatggggaaaatgctgaaaacgtccagcgcaaaaacctttatgtttaaggaggatgatggacatggctgatgtacttcgccgagcaattaaccaaaagaagcaatttttaaaaaccaaattactgctctcggaattttatcaaggaagaggggaacagcttgcggactacacgctgagtgagcttgagaaagaatacaagtcccttcagaaaatgaaaaaagagatctgacaatagatataaagaggtgagtctgctgaaaagcgggcttttttgttttgattttgaaaaggcgagaaagagggtaaactactactgttcaacgcataaaagcatgtcgaaatattttgcttaagcttatgggcgaagctgattgtaaacggctcatttctctagtagaatatgaatgctttgtgcaagctgaagagtagggggatgaataaaatgatgcaaaccatcttatcaaatgggatagccatggttctcataattctcattattaatattgtctatgtgtcattttttacgataagaatgattttaacgctgaaaggacagcgttatttagcggccggcatcagtacgattgaaatactggtttatgtgacaggactgagtctggtgctcgataacttagaccagattcaaaatgtgatcgcgtacgcgcttggttacggtcttggcgtaattgtcggcatgaaaatagaagaaaaattggcgcttggctatattatggtcaatgtgattacgaaggagctcgatcttgatcttccgaagcagctccgtgaaaaaggctacggcgtgacaaattgggtggcaggcgggcttgaaggcgaccgcacagcccttcagatcctgacgccgagaaaatatgaactccagctatatgatacgattaaaacacttgattcaaaagcctttattattgcgtacgaaccaaaaacaatccacggcggcttctgggtcaaagcggtgaagaagaggagaattaaagaataatggcaaagccgaagaagaaaaagtttgaagtgacagagcagcaaacgattgatgcggtgcttcagcaaatgaaagaagaaggatatctgcctgtaaggcgaatggaagaacctatttttatggaaaaaaaggaaaatgggtcaattcagatcgttccgtgcgggaaaaaaatcgtatttgaagggaaattgatctaaaacacgaacattagtagaatgaatttttgtatcgttcgataatatcgttgacattatccatgtccgttgttaagataaacatgaaatcaaaacacgacctcatataatcttgggaatatggcccataagtttctacccggcaaccgtaaattgccggactatgcaggaaagtgatcgataaaactgacatggatatatcgcagaagcgaacgactgacgatacatgtaccatgcccggtttgtattgcttcctcataagtgcaatgcagagcgggtattttttattttctgaaaacaaaagcattagaaggtggggaacagaatgcagccgctagtaggaatcatcatgggaagcacttccgattgggagacaatgaaacacgcatgcgacatacttgacgaactcaatgttccgtacgaaaaaaaggtcgtttccgctcaccggacgcctgatttcatgtttgaatatgctgaaactgctagagaaagaggcatcaaggtgattattgccggtgccggaggagcggcgcatctgccagggatgacggctgcgaaaacaacactgccagtcattggagttccggttcagtccaaggcgctgaacggaatggattcacttctttccatcgtccaaatgcctggaggcgtgcctgttgcgacaacatccatcggcaaagcgggtgctgtgaacgcaggcctgttagcggcgcaaattttgtcagcatttgacgaagaccttgcccgtaagctggatgagagaagagaaaatacaaaacagacggtgttagaaagcagtgatcagcttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtgaagcgattcgaaaattggctgaaatcagcgatatcatcacatatgagtttgaaaacatcgactatgatgcgctgcattggctaaaagatcatgcgtatctcccgcaaggaagtgagctgctgctcattacccaaaaccgtgaaacagagaaaaaagcaattcaatccgcgggctgtgaagtcgcaccgtacagcatcgtcaaaacaaagaatgaattgaaacaggcggtacaggagctcgggttacccgcagttctgaagacatgccgcggcgggtacgacggcaaaggccaatttgtgataaaagaagaggcgcaaatggagcaggcagccgctctgttagaacacggaacttgcattcttgaaagctgggtttcttttaaaatggaactgtcggtgatcgtcgtcagatcggtaaacggtgaaatttcaacatttccgacagctgaaaacattcaccacaacaatattcttttccaaagcatcgtgcccgcacgggtagagaaagggattcagcagaaggctgctgatctcgcagttaagcttgcagatgagcttaaccttgtcggaccgcttgctgttgagatgttcctgacagaggacggagagcttttggtcaatgaactggcgccaagaccgcacaattctgggcattatacgctggacctttgcgagacgagccagtttgagcagcatatcagagcggtatgcgggcttccgcttgggaagacagatttgctgaagccgggcatgatggtgaatcttctcggcgatgaagtgaagcttgttgaggaagacccggagcttttaaaagaggcaaagctatatatatacggaaaacatgaaatcaaaaaaggccgcaaaatggggcatattacatttatgaagcagcctgaagacgaatggattcaggagatcacaaatcaatggatgaatagagacggaggacaagcagaatgatcgaacgttattcaagacctgaaatgtccgcgatttggacggatgaaaacagatttcaagcatggctggaggtagagattcttgcctgtgaagcgtgggcggagcttggtgtcattccgaaagaagatgtaaaggttatgcgcgaaaacgcgtcatttgacatcaaccgcattttagaaatcgaaaaggacacgcgccatgacgttgtcgcttttacacgcgccgtttccgaatcactgggcgaagaaagaaaatgggtgcactacggattaacgtcaactgacgttgttgatacggctctttcctacttattaaaacaggcaaacgatattttgctcaaggatcttgagagatttgttgacattattaaagaaaaagcaaaagaacataaatacacagtcatgatggggcgcacgcacggcgtacacgctgagcctacaactttcggcttaaaacttgcgctttggcatgaagaaatgaaacgtaatcttgagcgcttcaaacaagcgaaagcaggcatcgaggttggaaagatttctggcgctgtcggcacatatgcgaacattgatccatttgttgaacaatatgtctgtgagaagctcggattgaaagcagcaccaatttccactcaaacccttcagcgtgaccgccatgctgactatatggcaacacttgctttgatcgcgacaagcattgagaaattcgctgtggaaatccgcggactgcaaaagagtgaaacacgtgaagtagaggaatttttcgcgaaagggcaaaagggttcatctgcaatgccgcataaacgaaatccgattggctctgaaaacatgacaggcatggcgcgcgtgatccgcggctacatgatgacagcttacgaaaatgttccattatggcatgagcgcgatatttctcattcttcagcagaacgaattattcttccggatgcgacaattgcgctgaactacatgctgaaccgcttctccaacatcgtgaagaacttaacggtcttcccggaaaacatgaagcgcaacatggaccgcactctcggccttatctattctcagcgtgtgctgcttgctttgattgacacaggcctgactcgtgaagaagcctatgatacagttcagccgaaagcaatggaagcgtgggaaaaacaagtgccgttccgcgagcttgtggaagcggaagagaaaatcacgtcacgtctttctccagaaaaaattgctgactgctttgattacaattaccatctgaaaaatgttgatctgatctttgaacgtttaggtttagcatagaagaagctattagcggcttcttctatgccgccgcagtttgaaaattcccaacattcgggttaggaggccttccgtgaatattgtgaagaatgaacttttatacgaaggaaaagcaaaaaagatctacaaaaccgatgacgaaaacacgctgtatgtcgtgtataaagactccgccactgcctttaacggcgagaaaaaagcagaaatcagcggaaaagggcgcttaaataatgaaatttcaagcctcattttcaaacaccttcatgctaagggcattaacaatcattttatcgagcgcatttcggaaacggaacagctcattaaaaaggtaacgattgtgccgcttgaagtcgtcgtcagaaatgttgtggcaggaagcatgtccaaacgtctcggcattccagaaggcacggagcttgagcagccgattatcgagttttactacaaggatgacgcgctgggtgatccgctcatcacagaagatcatatttggctcttaaaagcggcgactcctgagcaggtagaaaccattaagtccattacaaaaacagtaaatgaagagcttcaaagcattttcgacgattgtcatgtcagattaatagatttcaagcttgaattcggtctagatgcagaagggcaagtgcttttggcggatgaaatttctcctgacacatgccgcttgtgggataaagaaacgaacgaaaagctggacaaagatttattcagacgcaatctgggaagcttaaccgacgcatacgaagagattttcaaaagactgggaggcattcatcatgtataaagtaaaagtttatgtcagcttaaaagaaagtgtactagatccacaagggagcgctgtccagcatgccttgcacagtatgacttacaacgaagttcaagatgtgcgcatcgggaaatacatggagcttaccattgaaaaatctgaccgtgatcttgacgtgctagtgaaagaaatgtgcgaaaaacttcttgcaaacacagtgattgaagattacagatacgaggttgaggaggtagtcgcacagtgaaatttgcggtgattgtgttacccggctccaactgtgatatcgatatgtatcatgctgtaaaggatgagctcggccatgaagtggaatacgtctggcatgaggaaacaagtcttgacggcttcgacggcgtgttaattccgggagggttttcttacggcgattacttaagatgcggcgccatcgcccgatttgcgaatattatgccagctgtcaaacaagcagcggctgaaggaaaacctgttcttggcgtctgcaacggattccagattttacaggagcttggccttctgccaggtgcaatgagacgcaacaaagatttgaagttcatttgccgtccggttgaattaattgttcagaacgacgaaacgttattcacagcttcctacgaaaagggacaatcgattacaatcccggttgcccacggtgaagggaatttctactgtgatgacgagacgcttgcttcattaaaggaaaacaatcaaattgctttcacatacggctctaatattaatggaagtgtcagcgacattgccggtgtcgtgaatgagaaaggcaatgtattaggcatgatgcctcaccctgagcgcgcggtcgatgaactgcttggaagcgccgacggtcttaaattgttccagtctatcgtgaaaaattggagggaaactcatgtcactactgcttgaaccaagtaaagaacaaataaaagaagagaaactgtatcagcaaatgggtgtcagtgatgatgagtttgcattgatagaatccattcttggaagattgccgaactacacagaaatcggaattttttctgtcatgtggtctgagcattgcagctataaaaactcaaagccgattctgcgtaaattcccgacaagcggcgagcgtgtgctgcaggggccgggggaaggcgccggaatcgtggatatcggtgataaccaagcggttgtgttcaaaattgaatcacataaccacccatcagctctcgagccttaccaaggcgctgcgactggcgtaggcggaattatccgtgacgtattttcaatgggtgcacgcccaatcgctgtattgaactctcttcgatttggtgaactgacttcaccacgcgtgaagtacttgtttgaagaagtagtagcgggtatcgccggatacggcaactgtatcggcatcccgacagtcggcggagaagtgcagtttgacagcagctatgaaggaaatccgctcgtcaacgcaatgtgcgtcggtttaatcaatcatgaagacatcaaaaaaggccaggcaaaaggtgtcggcaacacagtaatgtacgtaggagcgaaaactgggcgtgacggcatccacggcgctacgtttgcttctgaagaaatgtcagactcgtctgaagaaaagcgttctgctgtccaagtcggcgatccgtttatggagaagcttttgcttgaagcatgtctggaagtcatccaatgcgacgccttagtcggcattcaggatatgggagctgccggtttaacaagctcaagtgcagaaatggcaagtaaagccggttctggcattgaaatgaaccttgacctgattcctcagcgcgaaacaggcatgaccgcgtatgaaatgatgctttctgaatcacaagaacggatgcttttggttattgagcgcggacgtgagcaggaaatcatcgatatttttgacaagtacgatcttgaagcggtttctgtcggacatgtgacagatgataaaatgcttcgcctgacacacaaaggagaggttgtgtgcgagctgcctgttgatgccttggcagaagaagcaccggtttaccataagccttctcaagagcctgcttactatcgcgagtttttggaaacggacgttcaggctccgcaaattgaagatgcgaatgaaacgctgaaggcccttcttcagcagccgacgattgcgagtaaagagtgggtgtatgatcagtatgactacatggtgcgcacgaatacagttgtcgctcctgggtctgatgctggtgttctcagaatccgcggaacgaaaaaggcgctggcgatgacgacagactgtaacgcgcgttatctctatcttgatcctgaagtcggagggaaaattgctgtcgctgaagcagcgcgcaacatcatttgctcaggcgcagaaccgcttgcggtcacagataaccttaacttcggaaacccggagaagccggaaatcttctggcagatcgaaaaagcggcagacggcataagcgaagcgtgcaatgttctcagcacaccggttatcggcggtaacgtatcgctttataacgaatcaaacggcacggcgatctatccgacaccagttatcggcatggttggcttaattgaagatacagcacacattacaacacagcatttcaaacaagcgggagatctcgtatatgtgatcggcgaaacaaaaccagagtttgccggaagcgagctgcaaaaaatgacagaaggccgcatttacggcaaagcgccgcaaatcgatcttgatgtcgagctgtctcgccaaagagcactgcttgacgcgattaaaaaaggcttcgttcaatctgcgcatgatgtgtctgaaggcggcttaggcgtagcgattgcggaaagtgtcatgacgacggaaaaccttggcgctaatgtgactgtagaaggggaagcggcgttattattctctgaatctcaatcccgcttcgtcgtttcagtgaaaaaagaacatcaagctgcgtttgaagcaactgtcaaagatgcgattcatattggtgaggtaacagctgacggaattctggcgattcaaaaccaagacggacaacaaatgattcatgcgcaaacgaaagagcttgaacgcgtatggaaaggagctatcccatgcttgctgaaatcaaaggcttaaatgaagaatgcggcgtttttgggatttggggacatgaagaagccccgcaaatcacgtattacggtctccacagccttcagcaccgaggacaggagggtgcgggcatcgtagcgactgatggtgaaaagctgacggctcacaaaggccaaggtctgatcactgaagtatttcaaaacggcgaactcagcaaagtaaagggaaaaggcgctatcgggcacgttcggtacgcaacggctggaggcggcggatacgaaaatgttcagccgctcctcttccgttcccaaaacaatggcagcctggcgcttgctcataacggaaatcttgtcaacgccactcagctaaagcagcagctcgaaaatcaagggagcatctttcaaacctcttcggatacagaggttttggctcacctgatcaaaagaagcggacacttcacgctgaaggaccaaattaaaaactcgctttctatgctgaaaggcgcctacgcgttcctgatcatgaccgaaacagaaatgattgtcgcacttgatccaaacgggctgagaccgctatccatcggcatgatgggcaacgcttatgtggtcgcatcagaaacatgcgcatttgacgtcgtcggcgcaacgtaccttcgcgaggtagagccgggagaaatgctgatcattaatgatgaaggaatgaaatcagagcgtttttccatgaatatcaaccgttccatttgcagcatggagtacatttatttctccagaccagacagcaatattgacggtattaacgtacacagtgcccgtaaaaaccttggaaaaatgctggctcaggaatccgcagttgaagctgacgtcgtaaccggggttccggattccagtatttctgcggcgatcggctatgcagaggcaacaggcattccgtatgagcttggcttaatcaaaaaccgttatgttggcagaacgtttattcagccgtcccaggctctgcgtgagcaaggcgtcagaatgaagctgtctgcggtgcgcggggttgtagaaggcaaacgcgtcgtgatggtggatgactctatcgtgcgcggaacaactagccgccggattgtcacgatgctaagagaagcgggtgcgacagaggtgcatgtgaaaatcagttcaccgccgatcgctcatccgtgcttttacggcattgacacttccacacatgaagaactgatcgcgtcttcgcattctgttgaagaaatccgtcaggaaatcggagccgataccctctcatttttgagtgtggaagggctgctgaaaggcatcggcagaaaatacgatgactcgaattgcggacagtgtctcgcttgctttacaggaaaatatccgactgaaatttaccaggatacagtgcttcctcacgtaaaagaagcagtattaaccaaataaaacttgaaaaatgacataaaggcagcgcagttcggctgcctttctctttctgccctcgttcggggagatattttgaaaagcgccttaaaggagtgaataggatgtctgaagcatataaaaacgcaggagttgacatcgaagccggatatgaagctgtaaaacgaatgaaaaaacacgtggagcgcacgaaacggcttggcgttatgggcagccttggcggttttggcggcatgtttgacctgtctgagctttcttatcaaaaaccagttctcatttcgggaacggacggtgtcggcacaaaattaaagctcgctttttccatggataagcatgacacgattggcgtggatgctgttgcaatgtgtgtcaatgacgtgctggcacaaggtgcagagccgctgtttttcctcgattatttagcggtcggcaaagcggacccagtgaaaattgaacagattgtacaaggtgtggcggaaggctgtgagcagtcaggttcagccttagtcggcggtgaaacggctgaaatgccggggctctatacagctgatgaatacgatattgccggtttctcagtcggagtggcagaaaaggacgaaatcgtgactggagaaaacattgaagagggccatctgttgatcggcctcagctccagcggccttcacagcaacggcttttcccttgtcagaaaagtgcttctggatgatgcggagctggacctcgatacaacatatgagccgtttgaccgcccgcttggcgaggaattgcttgaaccgacgaggatttacgtgaagcctgtgcttgccgcggtcaaaagcggaaaaatcgacggcatggcgcacgtgacaggcggaggatttattgaaaatattccgcgtatgcttccggaaggcttaagtgcggaaattgatcatggctcatggccgatcccgccgattttctctttcctgcaagagtacggcaagctgaaggaagaagacatgttcaacgtctttaatatggggatcggttttgttttggctgtcaaagaagagcatctgacagatgtgatcggaacgcttgaaagccatggagaaaaagcctatttaatcgggcgtgtgaaaaaaggtgaaggcgtcacattcggcggtgcagcactttcatgaaaaagtttgcggtatttgcatcaggaaacggttcaaacttcgaagccatcgttacgcgtttgaaggaggagaactgggatgcgtcagcagcgctcctcgtttgcgacaaaccgcaggcgaaagtcatcgaacgggcggaagcattccacattccatcctttgcatttgagccgaagtcttatgaaaacaaggccgcatttgaacaagccatcattgaacagcttcgtcttcacgaggttgaattgattgttcttgccggctatatgaggctgatcggtgatacgctccttcaagcatatggaggaaaaatcattaacattcacccgtcgcttcttccggcgtttcctggaatcgacgcagtcggacaggcgttccgggcgggtgtgaaggtggccggaatcaccgtgcattatgtcgatgaaggaatggatacaggtccgatcatcgctcaaaaggcaatcgaaattgatgaacatgatacattggaaacaatcgaacagcgaattcacaagcttgagcataaatggtatccgagtgtgattaaacagctattaggattaaataacagaggtgaaaaggcatgaccattaaacgtgcattaatcagtgtttcagataaaacaaatctcgttcctttcgtaaaagaactgacagagcttggcgttgaagtcatctccacaggcggaacgaaaaagcttcttcaagaaaacggtgtggatgtgatcggaatttcggaagtgacaggcttccctgaaattatggacggccggttaaaaacccttcacccgaatattcacggcggccttctggcggttcgcggcaatgaagagcatatggcgcagatcaatgaacacgggattcagccgattgacctcgttgtcgtcaacctctatccatttaaagaaacgatttctaaggaagacgtcacatatgaagaagcgatcgaaaatatcgacatcggcggacctggcatgctgcgtgcggcatcaaagaaccatcaggatgtcacggttatcgtcgatccggccgattacagcccagtgctgaatcaaatcaaagaagaaggcagcgtatctcttcagaaaaaacgcgagctcgcggcaaaggtattccgtcatactgcggcatatgatgcactgatcgctgactatctgacaaatgttgtcggtgaaaaagaaccagagcaattcactgtgacatttgagaaaaaacaatcgcttcgctatggagaaaacccgcatcaggaagcaactttctatcaaacagctcttcctgtcaaaggctccattgcgcaagcagaacagcttcacggaaaagagctttcttacaacaacattaaagacgcggatgctgcagttcaaatcgttcgtgaattcactgaaccggctgctgttgctgtgaagcatatgaacccgtgcggtgtaggaacaggtaaaacgatcgccgaagcgtttgacagagcgtttgaagcggataaaacatctatcttcggcggcattatcgcgctgaaccgtgaagtggacaaggcaactgccgaagcgcttcacaacattttcttagaaatcatcattgcgccttcattcagccaagaagcgctcgacgtcctgactgcgaagaaaaatctccgtctgctgacgcttgacgtatccgccgctgttcaaaaggaaaaacagctgacatctgttcaaggcgggctgctgattcaagatttagatatgcacgggtttgatgatgctgagatcagcattccgacaaaaagagaaccgaacgagcaagagtgggaagacttgaagcttgcttggaaagttgtgaagcatgtgaaatcaaatgcgatcgttctcgcgaaggacaacatgacagtcggcgtgggagcaggccaaatgaaccgcgtcggatcggcaaaaatcgcaatcgagcaagcaggggaaaaagcgaagggcagcgcgctcggttcagatgcatatttcccaatgccagatactgtcgaagaagcggcaaaagcgggcgttacagccatcattcagccaggcggatcgatccgtgatgaggattccatcaaaaaagcggatgaatacggcattgccatggtattcaccggcatcagacacttcaaacattaaggggatgaaaacgacgtgaatgtattaattatcggtaaaggcggaagagaacatacgctggcgtggaaggcagcgcaaagcagcctcgtcgagaatgtatttgccgctcccggaaatgacggcatggcagcttctgcacagcttgtaaacattgaggaaagcgaccacgcagggcttgtctcatttgcaaaacaaaatcaggtcggcctgaccattgtcggccctgaggttcctttaattgaaggtctggtggatgaatttgaaaaagcgggtctgcgcgtgttcggcccgtcaaaagccgcggcgatcatcgaaggaagcaaacagttcgctaaggatttaatgaagaaatacgacattccgaccgcagaatacgacacgtttacatcctttgatgaggcgaaggcatatgtgcaggaaaaaggtgctccgattgtgataaaagcagatggacttgcggctggaaaaggcgttactgttgctatgacagaggaagaagcaattgcgtgtctgcatgactttcttgaagatgaaaagttcggtgatgcgagcgcgtccgttgtcattgaagaatacctttctggtgaagaattttctctaatggcctttgtcaaaggagaaaaagtgtatccaatggtgattgcccaggatcacaagcgtgcgtttgacggagacaaaggcccgaatacgggcggaatgggcgcttactctccagttccgcaaatttcggaagaaacggttcgccatgctgtagaaacgatcgttaagccggccgcaaaagcaatggtacaagaaggccgttccttcactggcgttttgtacgctggattgatgcttactgaaaacggctcgaaggtcattgaatttaatgcccgtttcggcgatccggaaacacaggtcgtgcttccgcgcatggaatctgatctggtacaggtgcttcttgatcttttagatgataaggaagttgacttaagatggaaggataccgctgctgttagtgtggtgcttgcttctgaaggatatccggaaagctacgcaaaaggcacgccgatcggcagccttgctgcggaaactgagcaggtcgtggtcttccatgccggaacgaaagcagaaggcggagagttcgttacaaacggggggcgcgtcgccaatgtgacagcttttgatgaatcgtttgaagcggctagagaccgagtgtacaaagcggttgatgaaattttcaaaccgggactctttttcagaaaagacattggggcacgcgctttacaggctgcccaaaaataagtgaggaaaacccgcagattagctgcgggttttttgttatcaaaaagcgggatggcagctggaagaagaaagcacaacgagcgtggttggttttccatgggccatcgaggcgtcaataaaatcctcaagcgtatgtaccgattcagtcacgacctttgtcacatagctgtacatccccgtgatgcggtggttttctgctacatcagggtgcgcttttgcaaaggcggcgtagtgcttgcagcttttcggctccatgagaatgaaagcggtgacatgcttgtttagtttttcataacagatattcgcgctgtacccggtaatcactcctttgtcttccagcttcctgacacgctccgccgcgcttggcgagctgagtccgacaagctttcccagctcaaccatcgttaatctgccatttcgctgcaaatgcgagagaatctgaaggtctgtatcgtccatttgtctggctcctttacatatttaggcgaatgaatgaaaattcctttgatcgtaaggtaatgctgttgatttaccttcattgtagcatatggatgccgtcttattttttctataataaagccatcaacgggagaggaggcatcatgttgccagaattgcagcgctctattacttggatacaagggacggcgttaacgattggggcggttttaggatgcgggatattaattttgccgtctgttaccgcggatacggccggtccggcttctttatttgtttgggtattcatgtcttttttatcttttcttctcgtctgtacgctggcacggcttgtgaaaattgcgcccagcgcgggaggaatcactgcttatgtgcagctggcctttcagaaaaaagccggggctattttgggctggatcatgttaggttccgttccgatcggcgttcccatcatcgctttgactggcgcgcattacgtcagttacatcacagaggcggccgattggcagattacattgattgctggttgcatgctggctatatctattttgcttcatatgagaggcattcaactatcagcaaacatcagtacactcgttatttgtgtcatcgtatttctgcttgtcacttctattgctgtgtcattgccacacgtcacgatagcagaattcaaaccgtttcttccgcatggctggtctgccgcgggatctgtttctgtcatgatttttttctcttttgtaggctgggaaatgattaccccgttggctgaggaatttcatcgccctgaaaaagatgtcccgctcagcttgtttttggcagcgtcttgtgtggcagggctgtatatcatgctgtcatttgtaacagtgggaactcattcatacggagagaatggagaaattgcatcgcttgccatgctcatctcaaaaggagcaggggaaagcggtgtatacgtcacggtatgcttagcgctgtttattacattcgccaccatccatgccaatattgccggtttttcaagaatggtgtacgcattggcgagagaggggcacatacccgtattttttggaaaactcagtgcgacaaaacgtacgcctattcgcgttttgacagcgatggccgcagtgtttggcttagtgcttgcggcgcatggtctgtttcaaatcgatttgacgactctgttgaaagggccgagcgcggcttttatcgcatcttacatatgtacaatggcggcagcactgaaactgctgggcaggagagatataggctggtggatggcgctcggggcatttgtggcgtgcgcggtgatttattcattcagcggctgggcactgctttatccggcagtgctggcagctgcaggatatctctatatggaaacaaagggtgggcataaaaaaaagcttgatcacgttttgtgatcaagcttttccatttatccgttttgatgctcgttatttccagaatcgctgtgttgaaacatgtaggtcacaggacagaagcgcaagattcccgaacccgctttcatggcccccataaagatgtaaaagagatgcattctgcaccaaggttttttcgtaaactttgcactggcggctgacataatcgtcaatccgcaggcgattctgaacacggcattgatgagactgatgtttggcttcaaggaaatccgctccttttacttaaaaaagttttttaaccgaaccttcaaaaatttgtaacgtttttatcgtgcgtgatgaggaaggatgtgataccatgagtctaatacatgtaaaggagagtatgtgaatgtccgaacgcacctttaactggaaaaacaaagacatcagggcacaggttgatgttgtagactcaaagctgcttccaacgctccttttacggaatgctctcgtcttaaatccatatgtaaaacaatggctgaaaaaaaacatttggatttatcaggaccgcattgtttatgtgggtcatgaacttccgaatagagccgaagaaattcatacgattgattgtgaaggaaaatacattgtgccaggttatattgaaccgcacgcacatccttttcaaatatataatccccaaacactggcggaatatgtgtctcaatacggaacaacgacattcgtgaatgataacttatttttgcttttgcaaagcggaaaaaagaaagcgcttacgattttgaatgaactcaaaaagcagcctgtccagtatttttggtggtcacgctatgacctccagaccgaggttctgaacgaggaccacgtccttccatttgacgtcagaaaacagtggattgaacatccggatgtgattcaaggcggagaaatgaccgggtggcctcgcttggtagatggtgatgatttaatgctccactgcatgcaagctacaaagaaacagcgaaaacgcattgaagggcattttcccggcgcttctgataaaacgcttacaaaaatgaagctgttcggtgcggattgtgatcatgaagcgatgacaggtgatgaagtgatgagaaggctggaactgggctattatgtttcccttcggaactcttccattcgtcccgatgtaagaaaaatcttgcaagagctgcatgagaagggcttccgctattatgaccacttcttttacacgacagatggcgcaactccgaatttctataaaggcggcatgacaaacgagctgattcgtatcgcgttagaagaaggcgtacctgcaatcgacgcctacaatatggcatcatttaatatcgcaaagtattaccaaatggatgattatttaggagttgtcggaccgggtagactggcatcgctgaacatattggaagatccgttaaatccgaatcccgtgactgttctgtcaaaagggaccattctgcgtgaagacggctgtgatttgaaggcgtttacaaagacggactggcacaaaggcggtcttgtcccgcttgaactttcatatgatatgacgatggatgacttgcagttttctatgccgatgggcgtgaaaatgcggaatgcggttattatggagccgtatatgattgagattgacaattcgatggaacagctctcgtttgaccatgatgaaagttatttgacgatgctcgacagacacgggaaatggcgcgtcaatacgatgataaaagggtttgcctcaagcgtgcagggatttgtaagctcctttacgacgacgggcgacattgtcgcgattggaaaaaataaagcggatatgctgctcgctttcgcccggatgaaagaaatcggaggaggaattgttttagcggagaacggaaacattttgcatgaaatcccgcttgcgctgtgcggctgcgcctcttcggaagcgtatgaagacgtgcttgagaaggaacaaaagctgagagatcttttgactgaaagaggctatgagttttccgatcctatctatacgctgctctttttgcaaagtacgcaccttccgtatatacgcattacgccaagaggaatcttcgacgtcatgaaaaaaactgtactctttccatcgataatgcgttaaaatataaaagagcagggagccgacatatgaaaaaatggatgacagtttgcgcgctgtgtttcgtgttttttctgctggtatcctgccagcagaaggatgctgtcccggatactgcaaagaagctgaaagctcctttaacggggctaaagactgaacagaaggcgactgaacgccggcctgttgctgttgtggtgaacaatcacccgaaggcgaggccgcagtcgggtctgtctaaagccgacattgtcatagaagcgctagccgaagggcaaatcacaagatttctggccattttccaaagccagatgcctgaaactgtcggacctgtgcggagcgcgcgggaatatttcgtcactctcagcaatggctttgacagcatatttgtccatcacggctggagtcccggcgccaaaaagcagctggaatccggagctgccgattatatgaacggattggattttgacggaagcttattttggagagctgatttcagcaaaccgccccacaattcctatacgtcttatgattacataaaaaaggcggcagaacaaaagggttataagctgaagcaggaaacaaatccgctgctgtttcaaacatcagatgcaaaacctgcaaatgaatcttacaatgttcgggtagattatggaacaaaaaacgttacaaatcttgtcgaatacaactatgataaaaaagctgaatcttatacaagaagctctgatggtgtcataacgacagaccgggaaaccggaaagccggttgcaatgcaaaatattttcattgttgaagccagccatcatattattgatcaagatggaaggcgggacatcgacttggaatcaggaggaaaaggtctgttgtttcagcacggaaacgtcattgaaacagactggaaacaagtgaatggcagaattgtgccgataaaagacggcaagtggcttccgtttgtgccaggaaagacttggatcaatatcgtacctgatcttgatgcggcttccattagtaaaggagaaggtgtgtaacgatgcaaatcgataaattacgcggcaaagagctggaccagttatttaactcgatcttatcgctgaaagacctggaggaatgttaccgattcttcgatgatctatgcacaattaacgaaattcaatcgctggctcagcgccttgaagtggcgcgcatgcttcgcgaaggaaacacgtatcataagattgaaacagaaacaggcgcttccacggctacgatttcccgtgtgaaacgctgcttaaattacgggaatgacgcttatgaaatggcgcttgaccgtgtgaaggagacggaaactgagtcttcttcaaaataataaacaaccgccctgccgttcggcaagggcggtttctttatgaaacaaattgatggatcaggttgtcgatatcgatgagactgccatcctctttccgatagacaacatgctccttggaaaagtgaatcggcgaattgatccctgctgcggctgcaaggttaaatagtccctcgcgcaatgaaataacgtagttgcagacacgatgctgtttttcctcaacgctcaatgctttttgcaatttcggatctgtcgtcgccacacctgccggacaggtgttggtgtggcagacgagagcgcggatgcagccaacggaaaacatcatgccgcgtgcgatgttgacaaagtcagcgccgagggctaaggcgaccgcgattttatcaggagtcaggagctttccggaagcaaagattttcagcttgctgcgcaagccgtattgtttaagaagcgtgtcaacaataggcagcgctgtcataatcggaagaccgactgtatccgcgagctcgtaaaaggaagctccggtaccgccttcacttccgtcgatcgtgataaaatccggctgctttccgcttttctgcatatgagagaaaagctcatgcaattcttcaggatgccctgcgaccagtttgatgccgactggcttttgtccgacatctctaagtttttcaataaagtcgagcatttcaggagggtttgagaattcataaaagcggttcgggctgtcaatcgactttccaggttcgacattccgaatgtctgccacttcctctgatactttggcgccatccacatggccgccccgggttttcgctccttgtgccagctttagctcaaacgctttaatctggtcaatcctgctttttcttttaaattcctcccatgaaaattctccgtttcttttgcgcacgccgaataggcccggaccgatttggcaaatgatatcggcgccgccctttaagtgatactcagacaatcctccttcacctgtattcatccaggttccgcctgcctgatggagcccttttgagagcgccgtaacagcccgttctccaagagaaccgtagctcatggcagactggccgactaatcccttcacataaaatggcttctcgcatgtatgctcgccaatcacctgtacatcatcaggatggagaaaatacgggtctgccttgatatgttcggcatgctccttgcgtttgaatagattgtcagcatccattttatagatttgggtttcaatttttggcgtttgattgacgtgcatttcttccctttgttttggaaacatagcgttacggatataatagccaggtttatcaaaatctcttacagatccaaagcccatcattctgcttttgtatttgccggagatgacggtttgctcatattcctttcgtgaaaaaggctgctcctcattgtcattgctgtataaatactgtctgagctccggcccgattttttcaaggatataccgaaaccttccgatgacgggatagttgcgaagaattgagtgctcctgctgtttttcatcctttatgtagatccaggcaaacaagacgatcgggatagcgatgatccctatgataaatgcgatgagtgctattatgatggtttccatctctcagcctccctttttatgtaaccatttccacagttgaacactttccaaacaatagcagaaggaatctggtgaaaaatgtgtgcttctgccgatacaggactcagagagcaggtactgccatatgctctttttttatgaaaatagaatcaaaacacctttttcagtgaataacgagattaacggctttttccgtttttccgcgctatgtgaatttgttataatgtttaaatggtaacaaacgaatggaggaacgtatgacgtgtacgatgtaacggagtggaagcatgtttttaaactcgatccaaataaagatttgcctgacgaacagctggagattctttgcgaatcaggaacggatgcggtcattatcggaggcagcgatggtgtgacagaggataatgtcctgcggatgatgtctaaggtaagacggtttttggtgccgtgtgtccttgaggtatcagcgattgaagcgatcgttcccggctttgacttatattttattccgagtgtattaaacagcaaaaacgcggattggattgtcggaatgcaccagaaagccatgaaggaatacggagaactgatgtctatggaagaaatcgtggcggagggctactgcatcgcaaatccagattgcaaagccgcggcactgactgaagcggacgccgatctgaatatggatgatattgtcgcctatgcgcgtgtgtcggagctgctgcaactgccgattttttatttagaatacagcggcgtgcttggagacatagaagctgtcaagaaaacgaaggctgtattggaaacgtccaccttgttttacggcggcggcatcaaggatgcggaaacagccaagcagtacgcagagcatgcggacgtgatcgttgtaggcaatgctgtgtatgaagattttgacagggctttgaaaacagtagcggctgtgaaaggcgagtagtaaattgtacggatttggtttatgatagaacatatgttttgtataggcgggtgaacaaattttgaattatattagcaatcaattactaagcggtttaaaccccgttcagcaggaagcagtcaaaacaacggacgggcctcttttgctgatggcgggagcgggaagcggaaagacgcgtgtcctgacccatagaattgcttatttaatggcagaaaagcatgtggcgccgtggaacattctggcgatcacatttacaaataaagcggcacgcgaaatgaaagaacgtgtggaaagcatcctcggacccggcgcggacgatatctggatttccacattccacagcatgtgcgtgcggatcttgcgcagagatatcgaccggattgggatcaaccgaaatttctccatccttgatacggctgaccagctttcagtgatcaaggggattttgaaggagcgcaatcttgatccgaagaagtttgacccgagaagcatcctcggcacgatcagcagtgcgaaaaacgaattgaccgaaccggaggaattctctaaggttgccggcggctactacgatcaggtggtcagcgatgtatatgctgattatcagaagaagctattgaaaaaccagtcgctcgattttgacgatttgattatgacgacgattaaactgtttgaccgagtgccggaagtgcttgaattttatcagcgcaaattccagtacatccatgttgatgagtatcaggatacgaacagggcgcaatacatgctcgttaagcagcttgccgagcgtttccagaacctttgcgttgtgggggattctgatcagtcaatctacagatggcgcggcgcggatatcaccaacatcctttcatttgaaaaagattatccgaatgcaagcgtgattttgctagaacaaaactatcgttcaacgaaacggattttgcgcgcggcaaacgaggtcattaaaaacaactctaaccgcaaaccgaaaaatttgtggacggaaaacgatgaaggcatcaaaatttcctattatcgcggtgataatgaattcggagaaggacagtttgtggccggtaaaattcatcagcttcacagctcaggcaagcggaagctgtctgatatcgccatattataccggacaaacgcgcagtcccgtgtgattgaggaaacgcttctcaaagcgggcttgaactataacattgtcggcggcacaaagttctatgacagaaaagaaattaaagacattcttgcgtacctgcgcctcgtatccaatccggatgacgatatcagtttcacgcgcattgtcaatgtgccgaagcgcggagtcggcgcgacatcacttgaaaaaatcgcttcgtatgcggccataaacggcttgtcatttttccaagcgattcagcaggttgattttatcggcgtcagtgccaaagcggcaaacgcgcttgacagctttagacagatgattgagaatctgaccaatatgcaggattacttatccattacagagctgacagaagaaattcttgataagacggaatacagagaaatgctgaaggctgagaaatcgatcgaagcccaaagccgtttagaaaatatcgacgagttcctgtctgttacgaaaaactttgaacagaaaagtgaagacaagacactcgttgcgttcctgacagacttggcattgatcgcagatattgatcagctcgatcagaaggaggaagagtcaggcggcaaggatgcgatcaccctgatgacactgcacgccgcgaaaggactggagttcccggttgttttcttgatggggcttgaagaaggcgtcttcccgcatagccgttcactcatggaggaagcggaaatggaagaagaacgccgccttgcgtacgttgggattacaagggcggaacaggagctttatctgaccaatgccaaaatgcgcaccttgtttggccggacaaatatgaacccggaatctcgcttcattgctgaaataccggatgatttattggaaaacctaaatgagaaaaaagaaacaagagcgacgtctgcgagaaaaatacagccgagacgcggccctgtttcacgcccggtatcctacgccagcaaaacaggcggcgacaccttgaactgggcagtcggagataaggcgggccataaaaaatggggaacaggaactgtcgtcagcgtgaaaggcgaaggagaagggacggagctcgatattgccttcccgagccctgtcggcgtgaaacgcctgttagcagcatttgctcctattgaaaagcagtaattgaagaggaaaggaagaagcagatggacaaagaaacagcgaagcagcgggcagaagagctgcgccgcaccatcaacaagtatagctatgaatattacaccttagatgaaccgagcgtcccagatgccgaatacgacagattgatgcaggagctgattgcgatcgaggatgagcacccagacctcagaacgcctgactctcctacgcagcgcgtcggcggagccgtgcttgaagcgtttcaaaaagtcacccacggcacaccgatgctcagtctgggcaacgcctttaatgctgatgatcttcgtgatttcgaccgccgtgtgcgccaagccgtcggcgacgatgtggcgtataatgtggagctgaaaatagacggtcttgctgtttctctccgttatgaagacggctattttgtcagaggagccacaagaggtgacggaacgacgggagaggatattacggagaatctgaagacgattcgcaatatccccctcaaaatgaaccgtgagctgtcgatcgaagtgcgcggcgaggcgtatatgccgaagcgttcgtttgaagcactcaatgaggaacgaattaaaaatgaggaagaaccgttcgctaatccacgaaatgccgcggcaggatctctcagacagctcgatccgaaaattgcagcgaaacgaaacctcgatatcttcgtctacagtatagcggagcttgacgagatgggtgtggagacgcaaagccaggggcttgattttctcgacgaactcggatttaaaacgaatcaggaacgaaaaaaatgcggcagcatagaagaagtcatagtgctgatcgatgagcttcaggcgaagcgcgctgacctgccgtatgaaatagacggcattgtcattaaagtcgattccctcgatcagcaggaggagctcggttttacggcgaaaagcccgcgctgggccatcgcgtataagtttcctgctgaagaggtcgtgacgaagcttcttgatatcgaattaaatgtcggcagaacgggtgtgatcacgccgaccgcgattcttgagccggtaaaagttgccggcacaacggtctcaagagcatcccttcataacgaagatttaattaaagagaaggacattcggattttggataaggttgttgtcaaaaaagcgggcgatatcatcccggaagttgtgaatgtcctcgttgaacagcgtacaggagaagaaaaggaattcagcatgccgacggaatgtcctgaatgcggcagtgagctcgtccggatcgaaggagaagtggcgcttcgctgcattaaccctgaatgtccggcgcaaatccgggaagggctgatccatttcgtttcccgtaatgccatgaacattgacgggctcggcgaacgagtgatcacacagctgtttgaggaaaaccttgtccgcaatgtggcagatttatataagctgacgaaggaacgagtcatccagctcgagcgcatgggtgaaaagtccactgaaaacctgatcagctccatccaaaaatcaaaagaaaattcgttagagcgcctgctgtttgggcttggcatccgttttatcggatcaaaggccgcaaagacgctcgccatgcattttgaaagcttggagaacctgaaaaaagcctctaaagaggaacttctcgcggtagatgaaatcggtgaaaaaatggctgatgctgtgatcacctattttcataaagaagaaatgcttgaactcttgaatgaacttcaggagctgggcgtaaacacgctctacaaaggcccgaaaaaagtaaaagcagaggacagcgactcttactttgccggtaaaacaattgttctgacaggaaagctggaagagctgtcaagaaacgaagccaaagcgcaaatcgaagcgctgggcggaaagctgactggaagcgtcagcaaaaacacagacttagtcatcgccggagaagcggcgggaagcaagctgacaaaagcacaagagctgaacattgaagtgtggaatgaagaacagttaatgggagagctaaagaaataagaggagtgttttctattgaaaaagacgttggcattggcggcaacggcggcagtattaatgctgtctgcctgctcgtcaggtttcgggggggagaaggaggaagagattacgcaaaagacggcgaaatcgtcagaaaaagcgattgtcccgaaatataatatctctgactcctattacaaaatggtgctgccgtttaaggcaggcaaagcgcgcggcttaacaacggaacagctgaacactaggctggacattgacgagtttgaaacagggctgatgcgtcttgcccaagattctttctcgactgacgattatctgttccaagaaggacaatatttagatgaggatacagtattaagctggctggcacggaaaaaaacgggctctgatttgaaaaaagccgaaaaagaagataaaaacttcaaaaatgaaggcttgaacccggcgctcccgagttctggttcaacagaagaaaagaacgaaagcagcccaatttatttagcatccatgcttgagcacgattatttagtcagaaaagacaagaattctatccagcttggcggcgtcatgatcggactggcgttaaactcagtgtattactatcgtgaaaaaactggcgacccgcaaaaagaagtggagattaaagacagcacgcttcgccagcagggagaaaaaattgcacaggaggttattaaccgcctccgcaaaaaagataacttgaagaatgtgccgattaccgtggcgctctacaagcaggcgtcaaaaacatcgattgtgccggggaacttcattgccaaaacagaggtcaaagcaggctctactgatatctcaaattgggatgacatcaatgaaaaatatgtattctatccggcggatacaaccacagcagaaaagtacccggatgacaccgaggtctttaagcggttcaaaaactcaattgaagaatatttcccgaactatacaggcgttgtcggtacagcgctgtatgataatgatgaaatgaagaaaatgaagattgacataccaatgcaattctacggaaaaagtgaagttgtcgcgtttacccagtttttaacgggtgaagtgatggactactactctaaaggctcagttgatgtcgaagtcaatatcacgtcctcagacggacaggaagcggttattatccgcaatgccggagataaagagccgactgttcacatttatgactgatagaaaacccttgtgccatattggcacaagggtttttatgttacaattaacaggaaaagggaaattattttcgcttctgccgaaacacaaatcaaggggaggtatgttgatgctggaaatcgtgtgaaaacaatcattatcaaatctatagcaatgaaaggatgttagacatgcataaagatatcaaaaaaatatttgaggaagagcaggttttggcagaagctgcagcgagatacggtttctcaaaagatcaggtgcgttttctggctgatgcggaaaactatgtatatgaatgtatgaaagacaatcaaccttatattttaaagattacccatacgattcggagatcttctgattatatgatgggagagatggaatggctccgtcaccttgcaatagggggaatttcagtagccaaaccgctcccgtcgctgaacggaaaagacgtagaagcagtgccggacggaaacggcgggtcatttttattgagagtgtatgagaaagctccggggcaaaaagtggatgaatcggactggaatgaaacgctattttatgagcttggcagatacacaggcagcatgcacagcctgacaaaaagctacaaattgagcaatcccgctttcaaaagacaggaatgggatgaagaggagcaattaaagctgagaaaatatgtgcctgaagatcagataaaggtgtttcagcaagccgattctttgatgaatgaactgcggaggctcccgaaaagccaggacaactacggcttggtgcatgcggatctgcaccatggcaattttaactgggatcatggcaaaatcacggcatttgattttgatgatatcggctacaactggtttgttaacgatattagcattcttctctacaatgtcctgtggtatcctgttgtgccatatgatgataaagctgcgtttacagcagaatttatgacgcattttatgaaagggtactgggaggaaaatgagcttgaccctgcatggctgatgataatacctgatttcctccgccttcgccatatgctgatttacggattgctgcatcagatgtttgaccttaacacaataggagaagaagaaaaagaaatgctggccggtttcagaagagatatagagaatggcacgccgattacagcatttgatttttcagcactggtgtagatagaaaaagccaatgggattccagtcccattggcttttataatgtatcacacttcacgccgactacgccttcaatggctttaatgtcatagtagacatcggtcgtgtatctgtttttatggacgcggaccttcacttccataattggaaaatccttttcgcccaggtcgtcgatccgaacggagtgtgctttgatatctcttcttttcatttcttttaaaatctctgtcattttgtctttatcagaaagcgacattctgatgcggatgtctttttcctgcaggcggtcggggcctatttttctgaccacccatgggagaaattccacgctgatcaggatgaacagaagactggcaaacgcttctttataaaaaccggctcccgtagcaagcccgagccccgctgccccccagatcatggccgatgtcgtcaggccggaaatgacatcattgctttttcgcaggatgacaccggctccgataaacccgacgccggagatgatttgtgccggcagacgaagcggatccatcatgatgcggtagtatttagggaaatgatatgccgcattaatactgacgatcgtcagcatgcatgagctgactgcgatgacaatacaggtttttaatccgagcggcttattttttaattcgcgttcaagcccgatgaccatgccaatcaatgtggcaatgcccaatttcaataaaatatcaggatcaatataccagctcaacagcaacttcccccttctctatggtgtttttaaataaatatgattttctcacagtatttatagcaaaacaagagcacaaaagccaccaagctgcgcttgatggcttattgcttactttttgcgttttaacagcttttccatgacaccgaataatcggtaagaggcttttgcaggacgttttgtgatcatgctgacaatgatgccggcaatcatactgagaataaacccagggatgatttcgtacacaccggttgattttgccaggccggttgtaatccagattaacacggtcgcagccccgacaatcatggcagcaagcgcgccccattcgttcattcgcttccaatacagactgagcagaatcgcaggtccgaaagctgaaccgaagccggcccaagcgtatccgaccaaatcaagaatggtgctgttcgggttcaatgacaagagtaccgcgataacggcaatgactaagacggacaatcgcccgatcatgaccaattctttatcagaagcttttcgtctgaaaaatgaccggtataaatcctctgttacagcacttgctgtgaccaagagctgcgaggagatggaactcatgattgcagccaaaatagctgacaataagaaccctgtaattaatgggtggaacaagattttagagaagataatgaaaatcatctccggatcttttacagcaactccgaatttatgggcgtatgcaacaccgattaaacccgtcagcacggaacctagaactgtaatgatcatccagctcataccgattcggcgtgcaggttttaaatctttaatgtctttaatggccataaatcggacgatgatatgaggctggccgtagtagcccaacccccaggctaaataggaaataatgctaatgacgctcgcgcctttaaaaatatccaataaatgtggattaacagcgtcgatttcatggaaagtcggagcaacgccgcccacatgggtaaaagcaacgatcggcacaagcactagtgctgcaaacatgatcgcaccctgcacgaagtcagtcagactgacagcaaggaaaccgccaaacagtgtgtataacacgacaactgcagtggtcagaaacaagcctaatttgtaatccgcaccaaaagcagattcaaacagccgtccgccagataccataccggaagaggtatacaatgtgaaaaagatcatgatgatcaatgcagatacgattttcagcagtgatgaagaatgctggaatcgtttatcaaagaaatcaggaatcgtaatcgcatcatctgccgcttctgtataagcacgcagccttggagccagcaacaagtaatttgagtacgccccgattgtaagacctaaagcaagccataaggtggacagccctgtcgcaaacatcgcgccgggaacacccatcagcatccatccgctcatatcggccgcaccggcagacaaagcagtaacgaatggtccgaggcctcttcctccaagcatgtaatcattgatgtcagtggttttcttgaatgcataccagccgattaacagcatggcaataaagtaaattcctaaagatataataatttcaatactcacgttttaccctctcttcatttctaataatgttgcatcacctctcaaattgatggtgccagttaagcagcctggcgtaagtgcaaagcaaaagaaattcttttgcgggtgcacttggtaacttaacctaacaaagtattcccggccattcaagcgatgaaaccttgatcatgagcgagaaataccgttgcaaacctagaagggaataaagaataaaacgctttcaaaaaataattaaagtaaaaatattcagaaaaatatttcgtttctccttcgcctcattttagtataaaatatatagggtattgtttcgaaaacacaggcctgtcttaaggcgttttgttgctttaaagggcttgtttttgatatgatcagtattatatgacttaacggagaaatatgtggaggtggatcatatgtcacgaatttcaatagaagaagtaaagcacgttgcgcaccttgcaagacttgcgattactgaagaagaagcaaaaatgttcactgaacagctcgacagtatcatttcatttgctgaggagcttaatgaggttaacacagacaatgtggagcctacaactcacgtgctgaaaatgaaaaatgtcatgagagaagatgaagcgggtaaaggtcttccggttgaggatgtcatgaaaaatgcgcctgaccataaagacggctatattcgtgtgccatcaattctggactaaaggagggacacaagaatgtcattatttgatcataaaatcacagaattaaaacagctcatacataaaaaagagattaagatttctgatctggttgatgaatcttataaacgcatccaagcggttgatgataaggtacaagcctttttggcattagatgaagaaagagcgcgcgcatacgcgaaggagcttgatgaggcggttgacgggcgttctgagcacggtcttcttttcggtatgccgatcggcgtaaaagataatatcgtaacaaaagggctgcgcacaacatgctccagcaaaattctcgaaaactttgatccgatctatgacgctactgtcgttcagcgccttcaagacgctgaagcggtcacaatcggaaaactgaacatggacgaattcgccatggggtcatctacagaaaactcagcttacaagctgacgaaaaacccttggaacctggatacagttcccggcggttcaagcggcggatctgcagctgcggttgctgcgggagaagttccgttttctcttggatctgacacaggcggctccatccgtcagccggcatctttctgcggcgttgtcggattaaaacctacatacggacgtgtatctcgttacggcctggtcgcatttgcgtcttcattggaccaaatcggaccgattacacgtacggttgaggataacgcgtttttacttcaagcgatttccggcgtagacaaaatggactctacgagtgcaaatgtggacgtgcctgattttctttcttcattaactggcgacatcaaaggactgaaaatcgccgttccgaaagaataccttggtgaaggtgtcggcaaagaagcgagagaatctgtcttggcagcgctgaaagtccttgaaggtctcggcgctacatgggaagaagtgtctcttccgcacagtaaatacgcgcttgcgacatattacctgctgtcatcttctgaagcgtcagcgaaccttgcacgctttgacggcatccgctacggctaccgcacagacaacgcggataacctgatcgacctttacaagcaaacgcgcgctgaaggttttggaaatgaagtcaaacgccgcatcatgcttggaacgtttgctttaagctcaggctactacgatgcgtactacaaaaaagcgcaaaaagtgcgtacgttgattaagaaggatttcgaagacgtatttgaaaaatatgatgttattgttggaccgactacaccgacacctgcgtttaaaatcggtgaaaacacgaaggatccgctcacaatgtacgcaaacgatatcttaacgattccggtcaaccttgccggcgtaccgggaatcagcgtgccatgcggattagcagacggtcttccgctcggcctgcaaatcatcggaaaacactttgatgaaagcactgtataccgcgttgctcatgcatttgaacaagcgacagaccatcataaagcaaaacctgaactgtaaggggtgaaaagaattgaactttgaaacggtaatcggacttgaagtccacgttgagttaaaaacaaaatcaaaaattttctcaagctctccaacgccattcggcgcggaggcgaatacgcagacaagcgtcattgacctcggatacccgggcgtcctgcctgtcctgaacaaagaagccgttgaattcgcaatgaaagccgctatggcgctcaactgtgagatcgcaacggatacgaagtttgaccgcaaaaactatttctatcctgacaacccgaaagcgtatcagatttctcaatttgataagccaatcggcgaaaacggctggatcgaaattgaagtcggcggcaaaacaaaacgaatcggcatcacgcgccttcaccttgaagaggatgccggaaagctgacgcatacaggcgacggctattctcttgttgacttcaaccgtcaaggaacgccgcttgttgagatcgtatcagagccggacatccgcacgccggaagaagcgtacgcgtatcttgaaaagctgaaatccatcatccaatatacaggcgtttctgactgtaaaatggaagaaggctcacttcgctgtgacgccaatatctctcttcgtccgatcggccaagaggaattcggcacaaaaacagaattgaaaaacttgaactcctttgcgtttgttcaaaaaggccttgagcatgaagaaaaacgccaggagcaggttcttctttcgggcggcgtcatccagcaagaaactcgccgttatgatgaagcaacgaagaaaaccattcttatgcgtgtcaaagagggatctgacgactaccgttacttcccagagccagatctagtcgagctctacattgatgatgaatggaaggaacgcgtaaaagcaagcattcctgagcttccggatgagcgccgcaagcgttatatcgaagagcttggcttgcctgcatatgacgcgatggttctgacgctgacaaaagaaatggctgatttcttcgaagaaaccgttcaaaaaggcgctgaagctaaacaagcgtctaactggctgatgggtgaagtgtcagcttacctaaacgcagaacaaaaagagcttgccgacgttgccctgacacctgaaggccttgccggcatgatcaaattgattgaaaaaggaaccatttcttctaagatcgcgaagaaagtgtttaaagaattgattgaaaaaggcggcgacgctgagaagattgtgaaagagaaaggccttgttcagatttctgacgaaggcgtgcttctgaagcttgtcactgaggcgcttgacaacaatcctcaatcaatcgaagactttaaaaacggaaaagaccgcgcgatcggcttcctagtcggacagattatgaaagcgtccaaaggacaagccaacccgccgatggtcaacaaaattctgcttgaagaaattaaaaaacgctaataaaaaagcagcccttagaggctgctttttttatggtcaaattgagataaagacagagatgagagcacgaagcctttcaacttctttgtcgttggttccggtcaaattggacagcatgcctttaataatcggcttgcgcggtttatcctgagtcaattcttcttcgataacatcaagtgacacggtgatatcctcgggcagcgtgctgttttctttcactttctgaatgtcctcaagcagctggtctttccccgcaggcatcgggttgaaaatgtcttttgacacaatcggattgagtgcagaacggctcagcccctgtacaagatcatccagtctctcaataataaaggctgagatttcttctgcatcgatattaagctcaccgttaaataccatcacgttcatataagaatgcacaatgcctcttgccatgatggacagatctgcgacatactgcttgattccttcgccataggataccagcaaggcgttccggtacagcttatccgtctccatggttactttgtaaaagtattgcttgatttcttggttttccggaatgatattttcggtaagcaaaagaacgataaaatctttatgatcacgaaaatcctcaaattgtgcgccaatttgttttttcaaaacttctttaggcggctttcctgcgagatcttcttctatatttttcattttgttcatagacataccgatataatattcacaggcagataacagcagcgcttctttcgatttgaagtgcaaataaaaagcgcccttcgaaatgccgcattcactggcgatttcttggatcgtcgtagctgcgaatccttttttcgcaaataaacgaatgctggtttttatgattctctcttttttttcattcatgacgtgcttccccttaatccttgaaaaatttagtaaaattttctggtatatgagttgacgttgttgcattataacgtttagtattatatagaatgaccagtcagtcaataaaaaatgtaatggaggatatgatgaatcacgttattaatttcgttctgaaaaacaaattcgccgtatggctgatgacgattattgtaacggcagccggcttgtatgcgggtatgaatatgaagcaagagtctattcctgacgtgaacatgccttacttgacgatcagcacgacatatccgggtgcgacaccaagccaagtggctgatgaagtgaccaaaccggttgaacaagccgtgcagaacttggacggtgtcagtgttgtgacgtcgacgtcctatgaaaacgcatcgtcggtcatgattgaatatgattatgagaaagatatggacaaagcgaaaacagaagcagctgaagcgttagaaaacgtcaaactgcctgatgacgcgaaggatccggagatttcacgctacagcttgaactcattcccgattctgacgctaagcgtgtccagtgataaagataatctgcaagagctgacgaaacaagtggaggacagcctcgtttctaagcttgaaggcatagaaggcgttgcgtccgtccaagtatcaggccagcaggtggaagaggttgaattctctttcaaagaagacaaactgaaagaatacggccttgatgaagatactgtgaagaaagtgattcaaggttcagatgtgacaactccgcttggcttgtacacattcggaaatgaagaaaaatctgtcgtcgtcagcggcgatattgaaacaattaaagatttgaagaatatgagaatcccgacggcatcagcttcaagtgcaggcagcagcgcagcatctcaagcggcggcgcagagtgcacaggcagcccaaagcgcacaagcggcagcacaggcgcagcaaagcgcaagcacagcagtgccgacggtcaagctttctgacattgctacaattaaagatgtgaaaaaagctgaatctgtttcacgcacaaatggcaaagacagcatcggcatcaatatcgtcaaagcaaacgatgcgaatacggtagaggttgccgacaatgtcaaagctgagctgaagaagttcaaagaagaccataaaggcttcaattacagcgcaactctcgacatggcggagccgatcacacagtcagttgacacgatgttaagcaaagccatcttcggtgctatttttgcgattgtgattattctcttattcttaagggatatcaaatcaacattaatttcggtaatttcaattccattatcattgctgatcgcactccttgtgctgcagcagcttgatatcacattgaatattatgacgctcggcgcaatgaccgttgccatcggacgtgtagtcgatgactccatcgttgtgatcgagaacatttatcgccgaatgagactcaaagacgagccgctccgcggaaaagctttggttcgtgaagcgacgaaggaaatgtttaaaccgatcatgtcatcaacgattgtgacaattgcggtattcctgccgctcgcacttgtaggcggacaaatcggtgagttgtttattccgtttgccttaacgattgtttttgcgcttgccgcatccctggtgatttcaatcacgcttgtgccgatgctcgcacacagcctgttcaaaaaatcattaaccggtgcgccgattaaagcgaaagaacacaaacctggcagacttgcaaacatctataaaaaagtattgaactgggcgctgagccacaaatggatcacgtctatcatcgctgttctgatgctccttggaagcttgttcctcgtaccgttaatcggtgccagctacctgccgtccgaggaagaaaaaacaatgcagctcacatacagcccagaaccgggtgaaacgaaaaaagaagccgaaaatgaagctgaaaaagcagaaaaaatcctgcttgaccgcaagcatgtcgatacggttcagtattcattaggctctggcagcccgcttgccggaggagattctaacggtgcgttattctatatcaaatatgaaagcgacacacctgactttgataaagaaaaagataacgttctgaaggaaatccaaaagcaatctgaccgtggagaatggaagtcacaggacttcagctcttcaggcaataacaacgaattaacatactatgtgtatggcgattctgaaaacgatattaaagacacggtcaaagacattgaaaaaatcatgaaggatgaaaaggatctgaaaaacgtaaattcaggcctttccagcacatatgatgagtacacatttgtcgctgaccaagaaaaactaagcaagctcggtttaaccgcgtctcaaatttctcaggccttaatgtcacaaacatcgcaagaaccgctcaccactgtgaaaaaagacggcaaagagcttgatgtgaacattaagacagaaaaagacgagtataagagtgtgaaagatttagagaataaaaagatcacttcagcgactggacaggaagtcaaaatcggcgatgtggcaaaagtgaaggaaggatcaacatcagataccgtgtcaaaacgtgacggaaaagtctatgcggatgtcacaggtgaggttacatctgacaacgtcacagccgtatcagctgctatccagaagaaaatcgataagcttgaccatcctgataacgtatcgattgatacaggcggcgtatcagcggatatcgctgattccttcacgaagctcggtttagcgatgctggcagcaatagcgatcgtttaccttgtgctcgtgattaccttcggcggagcgctagcgccatttgcgattctgttctcattgccgttcacagtcatcggtgccctggtcggactttacgtatcaggtgaaacgatcagtctgaacgcaatgatcggtatgctcatgctgatcggtatcgttgtcacgaatgccattgtcttaattgaccgcgtgattcataaggaagcggaaggcctgtctacgagagaagcgctcctggaagccggctctacacgactccgtccgatcctgatgacagccattgcgacaatcggcgccttgattccattagcactcggcttcgaaggcggaagccaggtcatttcaaaaggactcggcgtcacggttatcggcggtttgatcagttcaacgcttctgacgctcttgatcgtgccaatcgtatatgaagtattggcgaagttccgcaagaaaaaaccgggaacggaagaagagtaaaaaaactaaaagcctcagctctgctgaggctttcagcttgttgaaaaaccctcgcattcgttgtcaggtctgcgcgtcggtgctcacgaattctacattcgctccgctccaatgctcccccttcctagactacaagggttttcaatcaagctgaaagaatgttaaggatgacaaaagctcaaaacaagaatcagttttgagcttttgtgcgttttcacctgtaagattatgtacattttgttgcgatttttttaactcatagtataattaaaggttgttagtgtaaaaatggatcggatactcttaagtaggatgatgagataatgaaacgtgcacgcataatatacaatccgacttcgggacgggagatctttaaaaagcatcttgcccaggtcctgcaaaaatttgaacaagccggctatgaaacctccacccatgcgacgacatgcgcaggagacgctacacacgctgccaaggaagcggcattgcgtgagtttgacctgatcattgcggcaggcggagacggaacgatcaacgaggtcgtcaacgggcttgcgcctttagacaaccgtccgacactcggtgtgattcctgtcggcaccacgaacgacttcgccagagcgctcggcattccgcgagaggatattttaaaagcggcagatacggtcattaacggcgtcgcccgcccgattgatatcggacaggtcaacggccagtattttatcaatatcgccggaggaggccgtctgacagagctgacgtacgacgtgccaagcaaactcaaaacaatgctaggccagcttgcttattatttaaaaggaatggaaatgctgccttcacttcgtccgacagaagtcgagattgaatatgacggcaagctgtttcaaggtgaaatcatgctgtttttggtcacgctgacaaattccgtcggcgggttcgaaaagctcgcgccggattccagcctgaatgacggcatgtttgatttgatgatactaaagaaagcaaaccttgctgaatttatcagggtcgcaacgatggcgctccgcggcgaacacatcaacgaccagcacattatttatacaaaagcgaaccgcgtgaaagtcaatgtatcagaaaagatgcagctgaacctggacggcgagtacggcggcatgctgccgggcgaattcgtgaatctgtaccgacacattcacgtcgtcatgccgaaggagaaagcggaacagctggatgactaaaaacttggcttnnnnnnnnnnnnnnagaaagttgacaaaatcctaaaacggttttttgttttaggattttgttaccttttcagttcagcgtgattgaaaacctttgaagtctaggaaggccgagcattggagcacaacgaatatgtttattcgtgagcaccgacgcgcaggtctgacaacgaatgcaaaggtttgtcgacacgctgaaacttggctttaataggccaagtttttctttcgcttaaaacaagaggtgaacatacatgaaaatgaaacccccagtagaaaaaaacgaatactacgacgtgacatttgaagatttgacacatgaaggagcgggcgtcgcaaaggtgcagggcttcccgatcttcgtgccgaacgccctgccggaggaaaaagcccagatcaaagtcacacgcgtcaaaaaagggttcgccttcggccgcctgatcgagctgaaggaagaaagcccgcacagaacagatgccccatgcccaatttacaagcaatgcggcggctgccagctccagcacatgacctacgaaggccagctcctgtttaaacagaaacaagtcaaagacgtcttagaacgcatcggcaagctggacctgtccaacgtcaccgtacacccgacactcggcatggaagacccgtggaactacagaaacaaagcacaggtgccggtaggagaacgggaaggcggactcgtcgcgggattctatcagcaaagaagccatgacatcatcgacatgagcgcctgcctgatccagcaatccaaaaacgacgaagccgtccaagccgtcaaagacatttgcgcaaactacggtgtcaaagcctacaacgaagaacgccacaaaggctggctccgccacattatggtcagatacggcgttgttacgggcgaaacgatgatcgtcttcatcacaagaacaaacgatttcccgcacaaagcgaagatcatcgaagacatcacagcgcaattcccgcacgtcaaatccatcgtgcaaaacatcaacccaaacaaaacaaacgtcatttttggcaacgaaacaaacgtcatctggggcgaagaatacatctacgacctcatcggagacgtcaaattcgccatctccgccagatcgttctatcaggtcaacccggagcaaacaaaagtgctctacgacaaagcgcttgagtacgcagagctgcaaggagaagaaaccgtcatcgacgcctactgcggcatcggaacgatttctctatttctggcgaagcaagcgaaaaaagtgtacggcgtagaaattgtaccggaagcgattgaagatgcgaaacgaaacgctgaattaaacggcatcacaaacgctgagttcgcggtcggtgaagcggaaaccgtgataccaaagtggtacgaagaaggcattacagcagatacgctagttgtcgacccgccaagaaaaggctgtgacgaagccctcatgcggacaattgtggagatgaaaccgaagcgggtggtgtatgtgtcctgtaatcctggaacacttgcaagagatttgcgagtgcttgaggatggcgggtatcagacgctcgaagtgcagcctgtggatatgtttccgcatacgaatcatgtggagtgtgttgtcttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatagaaagggtttgagagaccgcaaaaaaaattttcggtgcagtccgcaaatggcagtttgggtgtttcgcgttatatttggttttatggaggtagtacaatctcaatttttgaactttggattgtggttattaccacttaccagtttcgtcttttagcagtttttctgtcttatgcatttctttgagcataggattcatgtagtcgttagctgattctagatatgctcttgtcagagtatctagtttatttctaactttagagaggtctttttcgaattgttcctctgttgaatgttggataaattcttttgcctcttcgtatctttttaatatgtttttcaccattggagttggactcttttgattgtttgtttttattgatgtgattgttaaattaatttgttttattaattctcttcttactgtcaaaacgttgctccttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcacgtgtgttttcaatctgtgtgaaatatctttgttgtcctgctgtcagattttcatacccaattgttttggccattgaatagaattcatcggcatctgcatagtcgtaattctttagtctttcttccattcttcaatctcgcgttccttcgcttcctctttcttaatcttcaagtaagcctcagtccgcttttcaatgtcgccttttttcttatgtatgtcgctctcacggtaagccttggcgttgtagtggatgggtgtggcgtttttgcctttgcctgttgcttcttggagcttttggaagtcggacttgatgaattgttcgtttggttctgacagggcgtattctgtcttcaggtcttcgtccaaggcgtccaatttttccagtgtttttttgcgtttgtcgttggcatcggccagctcgtctttgaaggtttctgttgaaaacaggtcgagcgggaggatgtcgtcgatatcgttcaggatgtctttcatcgcttttttctgttcggacatgatggattttgattttttattggcatttgccagttcgtgctccaggaaggattcttcgatgtatgcgtcagagagggctttgtcctccgcggctccggcgatgctattgaaaaatgcgattttcatgtcgatgtagtcgatccattggtcggtgacgccgacgtggtcgtgatagaaggctttgatgttgctggcgccttttcctgaaaattcgctgtcactgagatcagcgacactttttaacgcttttctcaagttgaccatttgcgttcttagttctttgtactcttttgcacggtctgtcgcttccgaaagcagtgttttcgcttcaaatactttcatgaccatttcccttcttttgttcactcaatatcaaaattttaccacggggcgggatgagggtgggggtgagaacgtgttttggtggaaaaatgagtcatttggcatgtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtccaatctcccgtcatccaccccgaagaagaccggatcttttttatctactccaatcttttcataaaagaaagcgtgctgctttcaacctcaacaggcgaacggtttaacaggcgtacgtttaaggtggcggatgttccttatattcaaatgaagtcatacaaatccacagaccttgtattattggcggaacacgagcctttttactacacgctggagaaggatgtgatcaaagagcaaccgctgtcagatccatttgcgttttggtatgaggggaaggatgtgtctgttaaggcctataatgttgatacgacggggaatgagatccgcataaatgataaaaaaatgaagaaggaatatagctttaccttgccttcgcttgtcacgatgggtgccagtgatgagaactttatttatatcattcaaagcatggctatttacgtgattgatagaaaaacagaggaaatgattgagactctgagtttagcttcatacgctgatcaattcgcagattcggaggaatttattgtcgcgagctcggatcataaattgactgtgattgaaaaagggacatggaaaacgacatttattccgtatcctgatgatcttgaatacgctgataccgtatactataacaaggaaagcggcagtttttacgttgcgtacgaagacaaagagggggaggcgaacttgctggaatatggggaggatttttcttttcacacatacagcttgacattcccttatatagaggcgaagtttaaggggaatctattgtatatagttgcccaggaagagcataaaaagggcatcggcgggtatatgggtgtgtttgatattcattctaagaagatgctttatcagtttgatttgcctgaggaacaggtgaaggttcaggattttgttgtggttgacaataagtgaatacgtatatgaaatagaatgacaaagacccttgcgtaaagggttcttttttacgaagaaaacaaattgacaggatgaaaaaacaatttcttccttctgtattgttttcaaaatttgggattgatagaatatgacatatctcatagagaaggagggaagccgttgagtcaagccataccgtcttcgcgtgtgggtgttaagattaatgaatggtataaaatgattcgccagttcagtgttccggatgctgaggttctgaaagcggaggtggagcaggacattcagcaaatggaagaagaccaggatttgctgatctattattctctgatgtgttttcggcaccagctgatgctggattatttggagccgggacagccttacgggaatcgccctacagtgacagaacttttggaaacaattgagacccctcagaaaaaactcacaggccttttgaaatattactctttgtttttccgcggcatgtatgaatttgaccaaaaagaatatgtggaagcgatcgggtattatcgcgaggcggagaaagaactgccgtttgtgtcagatgaaattgagaaagcggaattccattttaaagtggccgaagcgtattatcacatgaagcaaacccatgtgtcgatgcatcatattcttcaagccttagacatttatcaaaaccatcccttatacagcattagaacgatacaaagcttgtttgtgatcgccggcaactatgatgatttcaaacattatgataaagcgctcccgcatttagaaaaggcgctggaattggccatggacattcaaaatgacaggtttatcgccatttctctattgaacatcgcgaacagctatgacagatcaggagacgatcagatggctgtagaacatttccaaaaagcggcgaaagtaagcagagagaaagtgcctgatctgcttccgaaagtcttgtttggattaagctggacattatgtaaagcgggccaaacacagaaggcgtttcagttcatagaggaaggattagaccatatcacagcacgttctcacaaattttataaagaattgtttctgttcttgcaggccgtgtacaaggagactgttgatgaacgaaaaattcatgatcttttaagctatttcgaaaaaaagaacctgcacgcttacattgaagcatgtgcccggagtgctgccgctgtttttgaaagcagctgtcactttgaacaagccgctgcgttttatcggaaagtgctgaaagcccaagaagatattctaaaaggagagtgtttatatgcctattaagaaaaaagtgatgatgtgcctggctgttactctagttttcggaagcatgtcgtttccattcctgacaaactccggcggatttaaggaaacaacagatcgaaatacgacgtatatcgatcattccccttacaaacttagtgatcagaagaaagcccttagctagggctttttcttgctttacggaagacgttccattttccacagcggcattccttctatttctaacacaagacactcgaaacaaccaaaccatttgaggtataatggataaagtgaataacagtatttagattgatatatatgaaagagagtggaacatcatgggccgtaagtggaacaatattaaagagaagaaggcgtctaaggacgcaaatacgagtcgaatttatgcgaagtttggccgtgagatttatgtggcggcgaaacagggcgagcctgatccggaatccaaccaggcgctgaaggttgtgcttgagcgtgcgaagacttacagcgtgccgaaaaacatcattgaacgtgcgatcgagaaggcgaagggcggagcggaagagaattacgatgagcttcgttatgagggcttcgggccgaacggatcaatgattatcgttgatgcgctgacgaataatgtaaaccgtacggcgccggaagtgcgtgcggcgttcgggaaaaacggcggaaacatgggtgtgagcggatctgttgcttacatgtttgacgcgacggctgtaatcggtgtggaaggcaaaactgctgacgaagcgcttgaaatcctgatggaagcggatgttgatgtacgtgacattttagaagaggatgacagcgtgatcgtatatgctgagcctgatcaattccatgcggtgcaagaggcgtttaaaaacgcgggtgtcgaggaatttacagtagcggagctgacaatgcttgcgcaaagtgaagtaacgcttccggatgatgcaaaggaacagtttgaaaaattgattgatgcattagaagatttggaagatgttcaacaggtatatcataacgttgatttaggtgagtaaggagtgagcaggctgttatggcctgctttttttgtcctggaaattgttttagctgtctgtaggcggccgcctatacgatctataagatattctcatactctggactgtaacctatgtgaaggagagagtgaatatgactgatacaagacatatgtatggcggacctggttttggtcattatcagggctttggtattggccacccgggttatggcatgtatggaggccacccgggctttggcatgtatggaggccacccgggctttggcatgtatggaggctacccagatcacggcatacatggaggtgtcggcggctatccgggatatggaacgtacggcggttacccaagcggcggctatggaggctctccgggaactgtaagttatccgaacatgcaccatgaaaatgatggccatcaccactattatcaccatcatcatgatggaaaagataatcttcatcaccatcatcaccatgttggaaaggataattatcaccaccatcatgatggtcattatggccaccatcaccaccatatgggccactggggaaaagacggttataaataaagaagatgatggtataaagaggacactcttgcagatcaagagtgttttttatcttttttcttgactgttcagtctggaaactggtaacatttgtttcaggaggtgatcgtcttttggggaggaataaagaatttgatacggcacttgttcttcacagggcgatagaggtttttggagagtatggctacgaaggaacgtctcttcaggatctgctctctcatttaggcattgcgcgccagagcttgtatgatacgtatggcacgaagcgtgatttgtttttgtccgctgtgaaaacgtatcttgaagggaaaaacactgccgttatggaaaggcttgaagcgccaggatctgtaaaggaagccattcgtgatatttttcaggagggtgtcaatgccctgagggatccggaacgggcgaaggcgtgctacattgtgaacagcgcgattgaacagatcccgcatgaccctgagcttgcccggtattttgacagacaatccaagcagcttgaggacgctttttatcaggcgcttttaagggcgaaggatcaaggagaattgaatggcgaagatcctgatatatctgcgctcgcccggtacctgaatcagagcaggctgtcactgacatttattgcaaaagtgacggcagatatggatcgtcttcaggaccatgttgacgtgagtttatcagtgcttgattaacatgtggtaaagaattctttgcccatgtgtgtattttttggactgaatggtctggaaataaaaaaagaggtgatgatgaatgttgatgaatgaatttgaaaaagcatgtgaaacattgagaaagtttatggcttatatgcttgagaaggacatgaagagctggatggagctttgggatgagaatgctgtatttgagtttccttatgcgccggagggatcaccaaaaagaatagaaggaaaagcggccatttacaactatattaaggattatcctaagcagatccatctttcttcatttaccactccgacagtgtaccgttcagcagattcgaatacggtgattgcggagtttcaatgtgacggccatgtgattgagactggactgccttatcgccaaagctatatcagtgtcatcgaaatgagagacggccgcattgtgcgttatagggattattggaatccgcttgttgtaaaagaggcctttggaggatcatttttgcaaacagaggagagtgggaaatgatgaaacagaaaccgattttaatcacgggcgggactggcacagtcggcagccgaatcgccagccgtttagtaaagctgggatacagagtgcgtattgcaagccgaaaaaagggcgcgcttgcaagtgcggagtatgtgtattttgattggaaggacgcctccagttttacgcctgctctagaacaggtaaaagacatctatcttgttgctccggtcggtgtacttgatccggctccctatgtgcttccctttttaaaggaagcaaagcgtctcggcgcaaagcgggtagtgatgcaaagtgcgtctgttgtctccgagaacggtcccgtgtttggcgcgcttcaccaggcagtgcgcgagtttccagaatggacggtgctgcggccctcatactttatgcaaaatttcatcaatgtccagcatcgcatgtctattcaaacggaggggcgcatcacaacggcttcgggtgaaggaaaacttgggtttattgacgctgatgacatcgcagaaacagccgtcagggctttgattgatgatgttcctcatcaaacacatcatattctgacaggtcccgaggcgctgagctatgccgaagcggcggagatcattggagctgcggcgggacgccgggtggagcatgtcagcatttctcgttccgagctgcagcataaaatggaggcaggaggtttgcccgcggattatgcccattttatggcgaagcttgatgaggcaatcagccatggtgcggaacatcgggtaacggatacagtgaagcgtgtgacgggaaaagaacctcgttcgctgtcagagtttgcggctgctcatgctgcatattggaaacactgacctcattttggactgaatagtctagaaagaccttcggcgcttccgaaggtcttcttattgaaaaagctaagtcgtgttttagtcataatcatgcctcatgcctcatacctattaaggtcattgtttttgagaaaggaggagccggaatgaaggatatgcagccgtttacgcctgtcaaatcatatacgccctttcacagccgttttgatccctgtccgcccatagggaagaaatattacagaacgccccctaacctttatatgacctttcagcctgagcacatggagcagttttcgccgatggaggctttgaggaaaggcaccctttggaaggatctctatgatttttatgaaaacccttatcgagggggagacgcacatggcaaaaaaggttgacgccgaatattatcgtcagcttgagcaaatacaggctgctgattttgtgcttgttgagctgagtctttatttaaatacacatcctcatgatgaagatgcgctgaagcaattcaatcaatattccggctattcaaggcacttaaaaagacagttcgaatcctcttacggaccgcttctgcagttcggcaacagccccgcgggcaaggattgggattggggaaaagggccatggccgtggcaagtataaggaggaatgcctgaatgtgggtgtatgaaaagaagctgcaataccctgtcaaggtcagtacgtgcaacccgacgctggcgaagtatttgattgagcagtatggcggagcggacggcgagctggccgcagctctccggtatttgaaccagcgttatacgattcctgataaggtcatcggccttttaacagatatcggcacggaggagtttgcccatttggaaatgattgcgaccatggtctataagttaacaaaagacgccacaccggagcagctgcgtgaagccgggcttggcgatcattacgtcaatcacgacagcgcgcttttttatcataatgcggcgggcgtgccgtttaccgcgagctatatccaagcgaagggcgatccgattgccgatttatacgaagatattgccgcagaagaaaaggcgcgggcgacgtatcaatggctgattgatatttcggatgatcctgatttaaacgattccctgcgttttttgcgtgagcgtgaaatcgtacactctatgcgcttcagagaagcggttgaaattttaaaagaagaacgggataaaaagaagattttctaataggcagattggcctctctttcatacacccttttacatacagagaaaatggtctgtttttgcagtttggtctgcattataatcaaggtgtgtgtgcaagcttactttttgattgggaggcctttatgtcagcttttaagattgagaacgaaacgattgcagatggattttacgcgtgtccggccgtctatgaggatgcagaatcgattaccgggttgctcgtccgaacagctgaatggctccgggatcggggttctaaccaatggagcggacttctgaaagggcaagatatacatgatatcacggggtcaattgaaaagggacatgtgtttgtgtttaaaaaagatgaagagcttgcggctgtcgtgatgctgctgcctgaaccgagcgagtgggaccggacgctttggggagacgatgggcatgaggagtccatttatttgcaccgcctcgcagtaagccgccggtttgcgggacaggggctaggagcccgcgtccttcagtgggcggagacgggcatacactttccggaaaaaacgcggatccggcttgactgtgtcgctgatagcgacgccctgcattccttttatcggcgtatgggatatgaattcatgggtgctgatgcgtccggatatcatttgtttgagaaagagattacggcagaataagcgtcctttgcagggggcttttttgtcttttctaaaagggagggcaggcgatgtgtggccaatattatttgtgacagggattgtgacggcttgtctgtttgctggcgtatccgttttgatgcggatgagatttcctgacaaaagtcggccggaatggatgttggccgggctgatcgtccttggtgtgtttgcgatctggtacagcctcgtgtatgtacgcggctgggaaggggctgcgctcggaatgcttggattcaatgtcattttcggagccattgccggatatttgatcgataaggccatccggcgttacaggaaaagataaggctgctgccgtctctcatcatgtcgaaattttcacagaccggcaggaattttctttcgaaaggagaaatacatattactttaaaatgaaagcgttttccaaagcaggaaggtgatgttgatgatacacagtgtgacaaatgggctgaatcgtttttgtacgtgggtgatgagactggcctatttgaatgtgctttggattttgttttctcttgcaggcctggttgtgtttgggctgatgcccgctacttccgcgatgtttacagtggcgagagaatgggcgaaggggaatacagatgccccggtgtcttctgtcttttttcggacgtttaaaaaggaatggcgggcatcacagatcctcgggcttatcgttgtgacggctgccctgtttctgtttgcggatatgcggatagcggctcagatggatcagcctgtgctcgtcaatgtattcctgagcattagtttgattttcgcgtttgttgtgctgtatgtgttcccggtattttctcattttgacgtaaaaatcagagaggtgctgagcatcagctttttcattgccttcagccgtccggcggtgacgcttttgatggcggcgggcgctgtcggtgtgctttgtctcgttctgtttcatgtcacgtttctattgtttttcagcgggagtttactcagcctgatcttaacgaagctgtcctttaaagcgtttcggtcaatggatcagcggcaggagaaagaaaaggcggcatgaagaaaagagttgctggctggtacaggcggatgaagattaaggataagctgtttgtgtttctatcgttgattatggccgtatcctttctgtttgtatacagcggggtccagtatgcctttcatgtgtatgatgagcagatttaccgcaagtcctcggaggtgcttcggatgtcttctgaaaggatcgaagacgagctgaagaagatagaggatgtgtcatatgaaatcattacagacgaacagattcagcgcatcctgagtatgcaaaatcgggatgatacgtatgatcaatatcaaatgaagcaggagctgtgggatcagcttgcgggatatgccagcgatgaaaagtacatcgattccattcatgtgattgatgcccgcggctcagagtattcagccggaagcagttcttcagatcttttgcagcaggagcaggaagaggtatttaagcgagcgaaagcgaaaagtggaagaaatctttggatgacgctcggcgggtcagatcctgtcctgatttcagcacggcagatcaggtcctatcaccagctgagtttgaacggcttgggcatggcgctgatccaggtcaatgtaaaacagatgattcgtgatgtgccgaaggattggggcgattcagtcggagacattatgattgctgaccaaggcggtaatttggtgtatacggcacatgcatcagcgcatgttcctgaggcagcaaaagagacgctgaagcaccccggttatgacttgataaaaaagaatggcaaacgttactttatttcttaccttcaatcatcctaccaaaattggagctactataacgttatcccctttgatcagatgttcgcaaaaatttcctttatgaaaacagtgatcggcacatgctttcttctctttttctgtgtggttttgcttttcggaaggaaaatcgccaacagcatcacggagccgattgaacagcttgtgaccgcgatgaaatcggtacagcacagcggcattgaagcaggtgtgtcgctttctctgccggaacatacacaggatgaggccggcatgctgaaccgccattttactgtcatgatgaaacggattaatgagctgatggaagaaaatgtggaaaaacagctcatcattaaagaaaccgaattgaaagcactgcaagcccagatcaatccgcattttttatataacacgctcgagtccatcaattggctggccaaggcgaatcagcaaaagcaaatctcaaaaatggtggaatcgctcggttttcttctgcgaaacagcatacatatgaagaaggatatcgtgaccattcaggaggaggcggacattgtacgtcactatatgaccattcagcgatttcgatttgaagagcgcctgaatttcacgttggatattgacgatgaggtgaagcattgcctcattccgaaactgacgctccagccgcttgcggaaaatgcgattcaatacgcgcttgaaccctttacaaggccatgcgccatccggattcaggcgaaaaaggcgaagggctgtgtctgtattacggtcgaagataacggccctggcatggatggacggattcttgaatcaacgggtggaagaggaatcggactttggaatattcgcgagcgcatcagcctgacattcggagagccatacggcttgcggattcatagtgagcatgaaaaggcgacgaggattgtgatcacaataccgtgccgaaatgaggtggtgtgatgtataaaatactgctggctgatgatgagaggattatccttgatggaatggcgggaatcattgagtgggagtcgcttggcgcctcattgatcggaaaagcgcagaacggacatgaagcatatgaaaagattgtacataagcagccgcatatcgtcatcacagacgtcaaaatgcccggcatggacgggcttgagctgatcaaaaaggtgtcagccgtcagcccgtcggtgcaatttatcgtcctgtccgggtttggagagtttgaatacgcaaaggaagccatgaaatatggggtgaagcattatttgctgaaaccctgcaatgaacagcagattatcagctcgctggaggaaatcattgctgagctgaagcggcaagatgtgcacaaaaagaaaacagcccatctgaaacacgagctggaccatatccgttcctttgcagccgatcaatacttggaaggcttgatcgccggtgtggcccagctgtctccgccgccatcacttgccggaaaaaagatccgcctcttgatcttaaaaggggaacaatctattgatgccgcagccagagaggcactcggatcggcactgacagcggtttgcagcagcggagaatggaccgtactcgccgtagaggagaacgccgctgaaaaggtggcggaggtttttgcaacccgcaagatggccatcagtcaggcgggagaactccggcacgcggggcagctgtttcgtgacacagctgaagcgtctggtgacctgcatgggagcgcagtgatttcaaaaatgatcaggcttattgccgacgagctcggaaatccgaatctgtccttaaaatgggcggcgaaggatatgctgtttatgaatcctgattatctcgggaagttatttaagcaggaaacaggcgagaaattttcccaatatgttacacgagtgcgtcttgaacatgcgatgaaacagatgaaaatgaggcgggacgcgagtgtatcagaaattgctgaagaaatcggatttggcgataatccgaagtatttcagtcttgtttttaaaaaatataccggtctgacaccgtcagaattcagaagaaaacagggaggcgcttccgcaggatagccatctctgtttttttgactttcgccactgttttttgagtgtttcgccctatccgaacgctttaaaataaaatgtaagcacttacattaaaggggggattggtttgaagaagatttgttacgtgctgttatcccttgtctgcgtcttttttttcagcggatgttcagcgggtgaagaggcctcgggaaaaaaagaagacgttacactcagaatcgcgtggtggggcgggcagccaagacatgattatacaacaaaggtaattgaactttacgagaaaaagaatccgcacgtccatattgaagcggaatttgcgaactgggatgactactggaaaaagctcgcgcccatgtctgccgccggccagcttcctgatgtcattcaaatggataccgcttacttagcccaatacggaaagaagaaccagctggaagatttaacgccgtatacaaaggatggaacgattgacgtcagttcaatcgacgagaatatgctgtcgggcggaaaaatcgacaataagctttatggatttacgctaggtgtcaacgtgctgtctgtgattgccaatgaagatttgctggaaaaagccggtgtgtctatcaatcaggaaaactggacgtgggaggattacgagaagctggcgtatgatcttcaggaaaaagccggtgtctacggttccaacggaatgcatccgcctgatattttcttcccgtattatttgcgcacaaagggtgagcgcttttacaaagaagacggcactggcctcgcgtatcaagatgatcagctgtttgtcgattactttgaacggcagctgaggctggtgaaagcgaaaacgtccccaacacctgatgaaagcgcacagattaaagggatggaagacgattttatcgtcaaaggcaaatcagcgattacatggaactactccaatcaatatttgggctttgcccggctgacagactcgccgctgtctctctatctgccgccggagcaaatgcaggaaaaggcgctgacactgaagcccagtatgctgttttccattccgaaaagctctgagcataaaaaagaggcagcgaaatttattaatttcttcgtgaataatgaggaagcgaaccagctgattaaaggcgagcgaggcgttccagtctccgacaaggtggcggatgcgattaaaccgaagctgaatgaggaagaagccaacatcgtggagtatgtcgaaaccgcgtcaaaaaacatcagcaaagccgatccgccagagcctgtgggaagcgcggaggtcatcaagctgctgaaggatacgtcagatcagattctgtatcagaaggtatcgccggaaaaagccgccaaaacgttccggaaaaaggccaatgagatattagagaggaataattgacgggaaatggggctgacgcaatgaaaaaaagccggagtataagaaaagacaatctggcgggatatgcttttatttctccgtttatcatcgggttcctatgctttacggtgatcccgatgggggcgtccctgtttctgtccttcacgagctatgacttgtttacggcgccgaaatggatcgggctcgacaactttaaggaaatgtttacgggtgacgaaaagtattggcagtctctgaaggtgacgtttacgtatgtgcttgccggggttccgctccgcctcggcttcgcgctttttatcgctgtcattttaaacaatgcagcaaaaggaacggccatttacagaacgctcttttatctgccttcgatcatcggcgggagcgtcgccgtggcgattatgtggcgcaatatttttggcaatgacggggtcatcaatgcgctgctgttttttgtcgggattgatcaaaaaattctttggtaccagaatccgacaagtgcgctgtggacattgattctgctgtccgtctggcagttcgggtcgtcaatgctcatttttctggccgggctgaaaaacattccgtcttcgtatttggaagcggcaagtgtggatggggcaaatcgggtgcagcgtttcttcaagatcacgcttccgatccttacaccgattattttctttaatcttgtgatgcagacgatttctgcttttatgacatttacacctgcctatatcatttcgaagggcgagggcgggccgcttgacgggacacttctctattcgctctatttgttccagcgtgcgtttaactattttcaaatgggctacgcatcggcgatggcatgggtcatgcttgtcattgtcgggctgattacgctcatattgtttaaaacatcgtcatattgggttcattacgagtcaaaggaggaatgacggatggagccggtcaacgagcctgtcagaaaagccccggtttttgaaagaaaaaaagccgggcgcgtcagtcccaaacgcatactgttccatgtttttacggcaacgctggcggtgttgctgctgtacccggtcatttggctgtttgtcagctcgtttaaagaaagcgccagtatttttacaacctcacattctctcattccagacccttttattctcagtaactatgctgaagggtggaagggtatcgcgggacagccgtttctgacgtttattaaaaactcggcgatcattgtcggactgtcaacaatcggtgccgtcctgtcatcggctgtcattgcgtacggatttgcgcgtattccgtttaagggaaaaaaattttggtttgcgtgcatgatggggacgttaatgctgcctcatgaagtgttgatgattccgcagtatattatgtttgcgaaattagactggctgaattcctttaaaccaattgtcgttccgcaatttttcgggcatgcgttttttatctttctgatgatccagtttatccggacgattcccgaggagctggatgaagccgcgcgaatcgacggatgcgggcgctttgcctgcttttggcggatcattctcccgctgattgcccccgcgcttgcgacgtctgcgattttctccttctattggaagtgggaggagctgattcagccgcttttgtatttgaataagccggagctttaccctgtttcacttgcgctgaagctttttctcgatacagagtcggcttcgaactggggcgcgatgtttgccatgtcagccgtctcgttattgcctgtgattcttgtattctttttgtttcagaaatatatcgttcagggcatcagtacgaccggattaaaataaaaaggagtgttgcagatggcacagcttatctttgatgaagaaaaggtgacgtcggttattgaccggatcgtgaaacggacatttcagatggattttgcgtgggattggccgggcggcgtcgcgttttacggtgtggcggaggcctatgaagcgacggaaaacgaggaatatatcaatctgttaaaaacgtgggtggatgaacagctggaggatgggctgccgccgctttcgatcaacggagtttccattgggcatacgcttttgttcctccacaaggtgacaggtgatgacgtgtatttggaaacagcggccgagatggcggaatatgtgctgcataaggcgccgcgctttggcgagggtatccttcagcatacggtgaatgcggcagaatacgtgtttcctgagcaggcatgggcggatacgctgatgatggctgggctgtttatgctgagaatcgggcggatcatggagcgtgaggattattttgaagacggcctgcgccagtttcacggacatgaggacgtgcttcaggaccctgtcacgaatttgtactaccacgcctgggacaacaaagcgcaaaatcatctgtcggggatttattggggcagggcgaacggctgggcggcactcacgatggcaaaggcgctcccccttattgaggtgacacatccttcctttatgatcatcgacggatcgctcagagaccaactgagcgcgcttgtccggcttcaggatgaatcagggctgtggcatacgattttggatgatccggattcttatctggaggtttcggcatcagccggtattgcttctgctctgatgtcgagcggaaagctgtatacaaaatatgtgcagaaatcgcttgccgccattttggatgcggtggaagaggacggacgggtcagcaaggtatcggccgggacagccgtcatgaaaaatgccgaaggatacaaacaggtgccttacaaacgaatacaaggatgggggcagggacttgcgctgacgtttcttgctgatgttttgaaaacgaaaaaacacgtgtatcagtaaagacagcggcggggggaaagggatgaaaaaacagtctcaacagaaggaacgggtttctcgctggaagggaacgtatttcaaaagaaactttgtcttcattttgctgattgcctgtattcccggattgctgactggcggcgcaatctactttctttcgatcgacaaggtggagaaagagctgcagagatcgcatgaaacacaggtggcgcgtgaggtcagccgaatggatgagaagctgggagtgcttgaactggccctcacccagatggcctacgattcttcactgatgaacggattggctgagagggatttggagaaagactttacgttctcctatcaattaacgaaaaagctgtttcttttgcgggaccagcagccgctgatcgagcaggcctccatctttctgaacagcccccggcctcttgtgctgagccctgaatacagcgctttgacagaacaggaggcgcttcgcaagtatcgctcgctgctttcctcagaccacagcatttattggaaacggtcgggaaaccaagcgatgctgatccagctcattccgggcgcggcggagaaaccgttcggcgcgatcatgctggcggttgatccgaaagaaatggaatcaatcctgcaaagcttgtccccctatcctgatggaagtgcgctgcttttagatcaaaatcgagaggtgctgtttcatgagggagaaaaagattttaaaaagactttacttcaagagataaaaaaacagcctgctgagaacggccattttcagatggaatgggaaggcaaggtgtattctgtctcctttggagaaatgaaccggatgcatcagcaatggacctttgtgtcagcggcgcctctttcagctattacagcgccgatggtgtttttatcaaaagtgatcatcgtgatgctggtcatttgcatcggtttggcggtatgcatgacatggtatgcatcaaaaaaaatctatcgtcccattcagcatttgcttggcttgtttaccggaggagagaagaaaacatggcaggcgtccgggcaggatgaattcaagtggattgaaaagaggtggcaggatctatcccttgaaagccggaagctccaagagcagctcctgcggcagacgccccatatgaaaaagagttttttgcagcacctcttgcagggggatttttactatgacaacgaggacagtctcagatctcggatggaggaggccggctggaacatcggcgaaaacgtgtttcatgtgctggatctacaggtgacagggctccgctgtgaaaaaagcgtcttccgtgaaggtgatgaacagcttgccgtgtttaccctgaccaatctggctgaggaattggcggataaacgcgtttttcagctctccatacttgatatcggccggctttctgtcaccgttcttgtaatgaaaacaaacagctctgatctgaaggcgtatataacggagctggcacgccaatttggggatgtaaccggactatgcctgacctcgacattgagcagcaaaacggagcgtatcacggaaattccttctttatttcagaatgtgaaatgcggcaaatcccgcaggaagtttgctaaccgggatcaggtcattgatttgcaggccgacttccctcaggatgagcagttcgctccttattacccttttgagctggaaaaacaaattgttcaggccatacggctggaaagaaaacaggaagccaaggaactgatagatggatgtatgaaggaactggcggaaaaggtgtccatagacaggcatgtgcattccgccctgattcagctgttttcccgcattcaggaggatattttgcattccgggctcaatcccagtgaactgtttcagcaccggaatccgtttcttgatatttcagaattgcgcgaacccaatgaagcggcggcctggctgatggatgtagtggtgacgccttacctttccaagcttgagggcagaaaaaacagacagcaaaagcagctggcagaacgtgtgattgcgatgattcacgaacagtatatggcggacatttcattggaaagctgtgccgatgcgcttggcatgaattcatatacgttaagcaaggcatttaagcaagtgaccggcattaattttatcgattatgtgacccagatcagaatcgaaaaggcgaaggaactgctggtcaatacgaataaaaaaattcatgacgtgtcagaagaagtcggctaccgccacaattactttaaccggatttttaaaaaacaggtcggcatgccgccgggtgtcttcaggcaaatgtatcaggaaacgccgtgaaaggagagaacatgtgatgaagaaaccaattcaagtatttttagcgggagattccactgtgagtgactgcccgcctcatgaagcgccgatggcggggtgggggcaggtattcgggcaattgttttctgaagatgtgctggtccgcaatcatgccaaaggaggagcgagcaccaattcttttgtgaaggaaggaaggcttcaagcaattgccgagcacatcacacaaggcgattatttgttgattcaattcggccacaatgaccaaaaaccgcgggggacgaagccgtactccacatttcagcagtttcttaccttgtttgcagatacggcacgcgaaaagggcgcgcatcctgtgttcgtcacatcggtgcagcgccgccgctttgatgaatacggacggatcgagcattccctcggtgagtatcccgatgcgatgaaagcactggcgaaggagctcgatgtacctgtgattgatctgcttgcgaaaacaaaggtgctgtatgaagaatacgggccggaggagtcgaagcgattgttcgtttggtttcagccgaatgaacatccgaattacccggacggcattgaggacaatacgcatttttcggaaaaaggtgcaatggaggttgcgaagcttgtggcagaaggcattgaagagctcggacttccgcttaaggaccaccttgtgagccgggagggaaaagaacatgtataaggaaggcgcgtgcctgtaccgcaatccgctccggtctaaaagcgatgtgaaggactggcggatggagggaggcggacagatctcatttgacgatcacagcttgcacctgtcacatgttcaggacgatgtgcactttgtcttttggtgtccggaaacctttccagacggcatcattgtgacatgggacttctctccgatcgagcagccgggattgtgtatgctgtttttttctgctgcgggaatgggaggcgaggatttgtttgatccaagtctccagaaaagaacgggaaaataccccgagtatcattcgggggacatcaatgcgctccacctgtcgtatttccgcagaaaatacgcggaggaaagagcgttccgcacctgcaatttaagaaaaagccgcggtttccacctcgccgcaatgggggccgatccgctgccttctccagacgacgctgattctccgtatcgtatgaagctgatcaaagacaaaggctatgtgcacttttcaatcaatggtctgcccattcttgagtggatggacgacggcagcacatatgggcctgtgttaacaaaaggaaaaatcgggttccggcagatggcccccatgaaagccgtttacaggaattttgccgtgcatcaagcggtgagaagatgaagacgactgtaacggatgcgctttatgcaggctgcgaagcggtggtgaaaatagcatggctcaacgggctgtggctgttgtttacacttttgggcggcgttcttttcggatgggcgccgagcacagccgcgatgtgtgccgttataaggaaatggctgatggggcaaaaggatgtctcgatatttccgttatttctcgatacctataaaaaagagtttctcaaggttaatgcgatcggattggcgttttcggctcttttgatcatattgtctgccaactatcattatttttctgccagtacgaattggctgtcctttgccgtaacaaactgcacgctgcttgcagggcttttgtatatcatcgcgctgatgtatgtgtttcccctttatgtgcattaccagctcccgcttcgcaaatatattccgcaggcactgctgtttggcgccatgagaccgctgacaaccggctgtatgctgatcgggtgcggatttgtcctttatttgctttatacgcttcctggcctgatcccattttacggcccgtgtttatttgggcttgtgttgatgttttttgctcttaggggatttcaaaagacggaggcccggcaccatcaagccgggtaacaaaaaagtgacaaatacgcaaaaaagtgcagtgtccgaaataggcagatgcaaaaaagtgaaattgaagacagctcacacagcgcataaaatccaatttaagtaagcgcttacagataaatgagaaggagctgtctgatgattacacgaaggaaacgcatgtttaccgctattacgttgctggtcttgttggtgatgggaacctctgtatgtcctgtgaaagctgaaggggcagcgcggcagatggaagcgctgaaccgggggcttgtagcggtcaagacggacgggggcatttttgtcagctggcggtttcttggaaccgaaaacgcatctgttttgttcaatgtgtacagagacgggcaaaaactgaatgctgcgcctgtcaaaaccacgaactatgtggataaaaacggatcggcgggctcaacgtatacggttcgggctgttgtaaacggtaccgaacagccggcttctgaaaaagcctccgtatgggcgcagccgtatcattccgtcccgctggataaaccggctggcggcacgacgccaaagggtgaagcttacacgtacagcgctaatgacgcaagtgttggcgatgtggatggtgacgggcaatacgagctgatcctgaaatgggacccgtctaactcaaaagacaattcacaggatggctatacgggtgacgtgctgattgacgcgtataaactggacggcacaaagttatggcggatcaatctcggcaaaaacatcagagcgggcgcgcactacacccagtttatggtgtatgaccttgatggtgacggaaaagcagaagtggcaatgaaaacggcagacgggacaaaagacggcacgggcaaagtaattggaaatgccaatgctgattacagaaatgaacaggggcgtgtgctttcaggccctgaatatctcactgtgtttcaaggttcaaccgggaaagagcttgtcaccgcaaattttgaaccggcgcgcggcaatgtgtcggattggggagacagctacggcaaccgtgttgaccgttttctcgccggcattgcctaccttgatggacagcggccgagcctgatcatgaccagagggtattacgctaaaaccatgctagttgcctataacttcagggatggaaagctgtcaaagctttggacgctggactcctcaaagtcaggaaatgaagcgtttgctggacaggggaatcacaacctgagcatcgcggacgttgacggggatggaaaagatgagattattttcggctcaatggctgttgatcatgacgggaaaggcatgtactcgaccggcttaggccatggggatgccctccatacaggagatcttgatccgggccggccggggcttgaggtatttcaagttcatgaggacaaaaatgcaaaatacggcttatctttccgggatgctgcaaccggaaaaatcctttggggcgtttatgccggcaaggatgtaggccggggaatggctgctgatattgacccgcgttatccgggacaggaagtgtgggcaaacggttctctctactcagcgaaaggggtcaaaatcggaagcggggttccgtcctcgaccaacttcggcatctggtgggacggcgatctgctccgggaacagctggacagcaaccgaattgataagtgggattatcaaaacggcgtatcaaaaaatgtgctgactgcatcaggcgcagcggctaacaacggcacaaaagcaacaccggcgcttcaggctgatctgctcggtgactggcgcgaggaagtggtgtggagaacggaggacagcagtgctctgcgcatttacacgacgaccattccgactgagcacaggctgtatacactgatgcacgatccggtgtaccggctcggcatcgcctggcaaaatgtcgcctataaccagccgccgcacacaagcttctttttaggagacggcatggcggaacagccaaaaccaaatatgtatacgccttaactgaaagggggaaggaacgggctgcgcgcagcccgttcccattaaaatgaaaccaaaaaagaggcaaatggaatacttgaccagaggtttgattgcggtaaagacagaacagggcgtgtttgtcagctggcgttttctcggcacggatcataagacgacggcttttcacctttatcgggatggaaagcggatcacccgcgatccaatcgctgaaagcactaattttctcgatcaaaacggaacggctgactctgtttatcaagtggcggctgtcaataaaggacgggaagaaaagctttccaaggaagctcgtgtttggcaggaaaatgttctggaggttccgcttgccagaccggaaggcggtgtgacgccggacggaaagccgtacacttacagcgccaatgatgccagtgtcggggatgtagacggggatggagaatatgaaatgatcctgaagtgggccccatccaattcaaaagacaacgctcatgacggttataccggggaggtgctcatagatgcctataaactggacggcacctttttgtggcgcatcaaccttggcagaaacatcagggcaggcgctcattacacgcaatttatggtgtatgacctggatggtgacggaaaagcagaaatagccatgaaaacagctgacggcacaacagacgggaaaggacatatcatcggtgatgagcatgccgattttagaaacgaacagggcagaattttgtccggtccggaatatttgacggtgtttaaaggagaaaccggtgaggcgctcacgaccgtggaatatgaaccgccccgcggcaagctggaggattggggagacggctatggaaaccggatggaccgttttctcgccgggatcgcttatttggatggggagcggccgagccttgtaatggcgcgcggctactatacgagagccgtgctcgtggcatacgatttcagaaacggaaggctcaaaaaacgatgggtatttgactccaaccagccgggacatgaagcatacgcaggacaggggaaccacagcttgagcgtggcggatgtcgatggagacggaaaggatgaaatcatatacggcgcaatggcggtcgatcatgacggaaccggcctgtacacaacggggctcgggcacggagacgcgatgcatgtaggggatctggacccgtcacgaaaagggcttgaagtgttccaggtgcatgaggatgccacgaagccgtacggactgtcactgcgagatgccggaaccggtgagatattatggggcgtccatgctggaactgacgttggccggggcatggcggctcatattgacccaagctacaaaggatcgctcgtctggggaattgatccgccgggcaatgatggcatgtcgtacgggcttttcacgagcaaaggcgaaaaaatcagcgacaaagcgccctcttcagccaatttcgccatctggtgggacggtgatttggtcagagaactgcttgatcatgactgggacggaacgatcggcaggccaaagattgaaaaatgggatgctgaaaacggctgtctgaagacgatatttcagccggccggcgtgttgtccaacaacggcacgaaaggaaacccggttcttcaggccaacctgttcggagactggcgggaagaagtgatatggagaacggaagacagcagcgcgctccgtatctatacaacgacacatctcacccgccaccgcttttacacgctgatgcatgatccggtttacaggctcggcatcgcctggcagaataccgcctacaaccagccgccgcacacgagcttttacctcggaacgggaatgaaaaaaccgccgaatcccgtcctgtacatagcgggaagtaaagcggaggcgccgctgtaggaggactaaggataagaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagccgtataaaaaacgagggggaataaaaaatggcaaatcatatttatcttgccggcgattcgactgttcaaacgtatggagacagcacaaatcaagggggctgggggcagtttctcggctcgcatctgccggagcatattcaagtgatcaacagagcgatcgggggaagaagctcgaaaacatttgtggaagagggcaggcttcaggcaatcctcgatgtgattgagccggatgattggctgttcgtgcagatgggccataatgacgcgtcaaaaaataagccggagcgctacaccgagccctatactacttataaacaatatttaaagcagtatatcgcaggcgcgcgggaaaaaggcgcccatccgcttctcattacccccgtagcccgctttcattacgaaaacggcgtgtttttgaacgattttcctgattactgcattgccatgaagcagacggctgaagaggagaatgtccagctcattgatctgatggagaaaagtctcgctttctttactgagaagggcgaggaaaaagtgtacacctattttatgatttcagaagggattaatgattacacgcattttacaaaaaaaggcgcaaatgaaatggcgaaacttgtggcaaaaggcataaaggagctcggcctgccattgacagaatcgatcatcaaagaaaggtgaaaatgggatgagaaaactgtatcatggcgcttgctattatccggaattatgggatgaagagacgattcagcaggacattgacatcatgcgtgaagttggcgtaaatgttgtgcggatcggcgaatttgcctggtctgtcatggaacctgaagaaggaaaaattgacgtcggttttttcaaagaaatcatcgcccggctgtatgaaagcgggatcgaaacgattatgtgcacgccgacgcctaccccgccaatttggttctcacacggccggcccgaacgcatgcatgtcaatgaaaaaagagagatcatggggcatggctcccgtcagcatgcctgtacgaacaacccgtatttccgaaaaaaagccgccatcatcaccacagccatcgccaaggagcttggccggctcccggggctgatcggatggcagctagacaatgagtttaaatgccatgttgcagaatgcatgtgtgagacatgtttgcgcttatggcatgactggctcaaaaatcgctacggggtgattgagcgcttgaatgaagcttggggaaccgatgtgtggagcgaaacctatcagacgtttgagcaagtcccgcagccgggaccggccccgtttctgcatcacgcttccctaagcaccatgtatcagctgttttcgatggagatgatcgcttcgtttgcggatgaacaggccaaaatcatccgctgctattcagatgcgccgatcacgcataatggatcagtcatgttcagcgtggacaatgagcgaatgtttcagaatctcgattttgcctcctatgacacgtacgcttcgcaggaaaacgcctctgcctttttattgaactgtgatttatggagaaatttgaaacaggggcgcccgttttggattttggaaacgagtccgtcgtatgccgcctcgcttgaaagctccgcttacccgcacgcagacgggtatttgcaggccgaagccgtatcgtcctacgccttaggaagccaggggttttgctgctggctatggcgacagcagcgttcaggcagcgagatttcccacggttcggttctcagtgcctggggcgaacccaccatcggctaccaaaatgtgctggcggttgagcgggcaagaaaggaatcgagcctattattctatcgactgaacccgttcaagccgaggcggcgatgacttactatgacagagcaaaagcatttattaaaactgagcctcaccggggactccggcatcgttcgcttgtgacgcatttttatgaacgtattctcaacacggggattcaccgtgatcttattccggaaggcgctccactggacggctatcgcttgctgtttacgccatttatgccgtatttgtcttctgaatttatcaaaaaagcttcggcattcgctgaagctggcggcatctggatcaccgggccgctgacaggagggcgcacatgcgagcataccattcataccgattgcggacttggcgaacttgagaaaacgtcagggatcaaaacactttttacctttccgatgaatgagaacgtgaatacaggaaaagcgtttggcatcacggcgccgctcggactatggagcacggtgtttgacacagagagcggaaacacccttggtacggttgaagcaggaccgggggcgggccatgcttttctgacggaacagaattacggcgaggggaaaattgtcatgctgggctcgcctccatccgggaaagaaggggatgcgatgctggaagcgctcgtcaggcattacgcggaggaagctgttatttccagccggtcggatgttacgcccggcacgatcgttgccccgcgcaaaggcgataacggccttgtgtggatcatcgtgaatatggatggaaaaggcggaagtgtgacactgccggaagcgggaacagatctgttgacgaaccgtttggaaaaggcggggagactggcggtcggaccgcatgaataccgtgtgattcaatttgacaatcccagctgattctttgcatcgaatcagcttttttctatggagggagagaccgatgaaaaagatcaaatggttatcaggacagccaaaggtgataagcggtgtgacgtggggcgtgccatggaaaaaaggagaattaaaaaagggtgaccgtctggcgcttatgaataaaaacgcggaaacgcgatatgtgcaaaccgaaccgtcggcctattggccggatgggagcatcaagtggacgaagcacgcggcggtgtttggcggtaaggaaaaccaaagctttatagtgcaaaaaagagaagtgccgcagccaactgaatcgctcagcattcttgagacagagcatgacatccaagtgaatacaggagcactcgtttgtaccattcataaaacaggatctgatttcattcaatcattgcagatcaatggaaagccgatcgccgcaggcgggaggctcgttgcgataagagaaacgagaaaggagtcagcggcggaaacggttctatttcaagaagcatctgtcagctttatcaaacgggcgacgattgagcagagtggtcctgtcaaagcagtagtcaaaatcgagggagtgcatgtgctccataaaacgaatgaagaatggctgccgtttgtcatccgattgacgttttatgccgggctgtctgagctcggtcttgtgcacacgcagctgattgacaggagcggtaaacaagcatttattaagggactcggcatcgaatttgacctttttttggagggggagccgtacaaccgccatttccggtttgcgggagagaaagggatgtacaaagaacccgcccagctgtttggcacacgtaaattcaatgaacgatatccgctttatgaaaaacaaatcaatggcgaaatgctgtctccagatgaagagcataaggaatggtttgcgtacggaacacagaatgcggtttgggacgatgtgaagcttgttcaggattcaagcgatcattacagcctgtcaaaacggaccggaaaagattatgcgtggatcggcatgctgcatggatgccgggcgaaggggctttgctatgcgggcggagaaaatggcggtgtggctctcggcctgcggtatttctttgagaaatacccttcagcactggaaatcacaggtcttgccggcagccgccccaaaatgaccgtctggctttggcccccggacggcgaagcgatggatttgcggcattatacaggaaacacccacgtggccagcgcgtatgaaggctttgatgaaatgcgctctgatccgacaggcattgcgaacacaaatgaaatcagcctggcgtgcttttcgcacatgccgtctgacgaagtccttaatgcactcgctgacaaatggcaggcgccgccgcttattgtatgcgagccggacgtctattacgaatcaaaagcactcggggtctggagcatcattgacacatcccatccgtttaaaaaagagctggaagaacagctcgacgctgcctttctgttttataaaaaggaagtagagcagcgcagatggtacggattttggcattatggcgatgtcatgcatacgtatgacccgatccggcatatgtggcggtacgatctcggcgggtacgcatggcaaaacaatgagctcgttccgaccctatggctgtggcaggcgtttttccgctcaggcagagaggatatcttccgaatggcagaagccatgacccgccatacgagcgaaacggacagctttcacctcggtgaatacgcaggacttggttcacggcataacgttgtgcactggggatgcggctgcaaggaagcgagaatcagcatggccgggctttataaattctattattatctgacgggtgatgagcggacgggagatcttttgacagaagtgaaggatgccgattatgccctcgtcaaaaccgatccgatgcgcgctttttacgagaaaggcaagcacccgactcacgccagaacgggaccggactgggcggcgttttgctcgaactggctggcggaatgggagcggaccgaaaatcctgattatctccacaaaatccaaacaggcatcaactgtctgaagcggctgccgctccgcttattatctggcccgacatttgaatatgatccggcgacctcgatgcttcatcatatgggagacggcattgcgggcggatatcatatgatcattgccttcggcgcgccgcaagtgtggatggagctggctgagcttcttgatgaccgggaatgggaggatatgctgagtgaattcggcgaattttacacactcagtgatgaggaaaaacggaaaaaaagcggaggcgctcttcatgacgggcattttcactggccgatgttcgccgccggtatgacagcctacgctgcaagaaaaaaacaagatcctcatctcgccgccaaagcgtggaatcttttgctagaagataagctcagccatacgccgcttccgatcaaaccggagcgcatcgagacatggacgcagctagaggagcttccatgggtgacaacgaacactgtctctcaatggtgtttaaatgtcatagcggcgctggaactgatcggagattcccttccggcaaaaaaagaaacatcgggcaaaaaaggataacagccggaatttcataggagaaatggtgcaaaaaatgaagattgcaagaatttatgtaagcgctttatattgagaggggcaaaggggaaatgcaaattgaaaaaagggggacatacgcaacatgaaaataagaatgcgaaagaaatggatggccttgccgcttgctgccatgatgatcgccggatgcagccattcggaaacatccaattcagcaagcggttcgaaagatacgatcaaaattatggcgccgcttttatcgccggaaagcccgagtgataagagcccttcattaaaagcgctcgaaaaatacacaggcaaagagattaaggtcacatgggtgcctgattcatcctacaacgacaaattcaacatcgtcatggcttcaggagagatgcctcacgcgattgtcattaaagataagtcagcgggctttatcaagtctgtcaaagcaggggcgttttgggagctgtctccttatttaaaagactacaagaatttaagccaggcagatgaaaagattttgaagaacagctcggtgaacggcgaggtgtacggaatctatagaacgagggatctgatcagggcgtgtatgatcatcagaaccgactggctgaaaaatgtcggtctggatatgccggaaacgcttgatgatttctatgaagtgctgaaagcctttaaggaaaaagatcctgacggaaacggcaaggatgatacgtacggcatggtcgtgccgaaatggatgggactcggcaacggaagcccatgggatgttctgcaaatctggttcggcgctccgaaccgctacggtgttgaaaacggaaagctgattccggattttacaacgaaggaatacatggatgcgctcacgttttttaaaaagctctatgatgagggcttgatcaataaggactttgctgtcatggattctgcgaagtggaatgatccggttgtaaaaggaaaagcgggtgtcatcgttgatacaggctcaagagcgtctcaaatccaaagcgcgatggaggaggcggatgagtcgaacaaggatatcattgatatcgtcggctcgcttgagggaccgaatggcaagcgcaccttcccgacatctggttattcaggcatgatcgcgataccaaaatcaagcgtcaaaaccgaaaaagagctgaaagaggtgctgtccttcctcgataagatgaatgacaaggaagcgcagattctcacgaacaacggagtgaagggccgcaattacgagctcaaggacggcgtattcacctcacttgaaaaaaacaacaaatctctcctgtatgagcatgaaggcttggcacagttcagcatgtcgattccgaaaagcgagtattacatcgaagaccagaaaaccaagctcttccagcatcgcaaggacatcataaccgaaggagaaaaaatagcggtctttaacccggctgagtcgcttgtatctgatgtctatacccaaaaaggagcccagcttgacaacatcatcctcgacgcgagaacacaatttatcattggagaaattgatgaaaaagggttcgatgatgcggtggagctttggaaaaaaagcggcggcaatgaactgatgaaggacttgaacaaattgtaccaatcgtcaaaataaaccgatgcgcctgcctttcggcgggcgccccggtatcacgaaaggagaacagatatggaaacagtgccgaagaagggagatgcacctgttctcaccgctggaaaaggcatcagctggatggctgcgctcaaacgggacaaatggctttatcttcttcttattcccggtctgctttatttcttgattttcaaatacttgccgatgtggggcgtgctcatcgcttttaaagactactcgccatatctcggtttctggaaaagcgaatgggtcggctttgattatttcaaagacttttttatgaatccggattttttccggctgctgcgcaacaccctcatgctggcgagcctggatcttttgtttgcctttcccgcgcctctcattttggctctgcttttgaatgaggtaagaaaggccgtgtataaaagatgtatccaaacctttatttacgtaccccattttgtatcatggacaattgtggtcagcatcaccttcgttttctttactgtcgatacaggtgtgatcaacaaattgattatgagcctgacaggtgagcagatttctttcttgtcggatgcagactggttccggccaatgattgtgatgcaaagcatttggaaggagacaggctggggaacgattctatttttggcagcgcttgctacggttgatcaagagcagtatgaagcggccatcatggacggagcggggcggttcaggagaatgtggcatattacgctgccggcgatcagaagcaccattatcgttttgttgattttaagaatcggcagctttttgaatcttggctttgaacaggtgtatttgatgacgaactcactcaaccgcagtgtggctgacatcttcgacacgtatgtgtatatgatggggattacccaaggggcgtatagctacagcacggcggtcggtttgtttaaatcagttgtcgggattatcttgatttttggagccaattacattgcgaaaaagtttgatcaggaaggattgttttagaggagggagaggtatggctgaaattcacacgatgcacaacaccaaagccggacgggtgtttgacgtctgcaacattctgtttctcggcggtgtcggcgcgattaccattttgccgtttttatatattatcgccggtttctttgcgacagaagcggaactcgcccagcggagcttctttattttcccgaaaacctttacacttgatgcttacaagtatgtgttttcgacaccaacgttccttcgaagcatgggtgtgtccatcttcatcacggtggtcgggacggctgtacagctgtttttcaccttcacgatggcgtatccgctggcgaagcggcatgtgaagggacggaatctgctgttgaatctggtgattttctccatgctgttttcaggcggcatgattccgacgtaccttgtcgtaaaatcacttggccttttggatacgtattgggcattgattctgccgatggcgattaatccgttcaaccttattattatcaaaaacttctttcagcagctgccgcgcgagctggaggaatcagcaaaaattgacggctgttccgaaatcggcgtcttctggcggatcgccctgccactgtcaaagccagttattgcgacctttgcgctgttttatgcggtcgggatttggaatgatttcttccacgctctcttatatatcaatgacagtgcaaaatggccgctgcaaatggtgcttcgccaagtcacaattttatcggatttaacggcgaccaatggtgatacgatgcaaaatgcagttccgccggagcagggaattaaactcgctgtcattgtcattgcgacgctgccgattttggcggtctatccatttttacaaaaacactttgcaaaaggaatgctgatcggttcggtgaaaggctgagaaagggagtgtttcatatcagtacattagatcagattaagattgcctatatcggcggggggtcccaaggctgggccagaagcctgatgagtgatttgtcgattgatgaacggatgtcaggcacggtggcgctctatgatcttgattttgaagccgctcagaaaaatgaagtgatcggcaatcacagcgggaacggcagatggagatatgaggctgtttctactttgaaaaaggcgttatcagccgctgatatcgtcattatttccattttgccgggatcactggatgatatggaagtcgatgtccacttgcctgagcgctgcggtatttatcagtctgtaggtgatactgtcgggcctggagggatcatcaggggcttgcgtgctgtgccgatatttgcggaaattgcccgggcaataagagactacgcacctgaatcatgggtcattaattatacaaacccgatgtctgtctgtacaagagtgctgtataaagtgtttcccggaatcaaagcgattggctgctgccacgaggtattcgggatgcaaaagctattggcggaaatggtcacggaaaggctggggatagaggtgccgcggcgtgaggatatccgcgttaatgtgctcggcattaaccattttacatggattacggaagcctcttatcgccatattgacctgctgcctatattccgtgaattcagcgcgcactatggggaatcaggatatgagctggagggggaaagctggagggacagcatcttttgttcggcacaccgtgttgcgtttgatttatttgaaacgtatggcgccatccctgctgcgggagacaggcatctggcagagtttcttcccggcccatacctcaaacagcctgaagtatggaaatttcatctcacacctatatcattcagaaaacaagacagagcagagaaacgacaagaaacagaacggttgatcgtgcaacaacggggcgttgccgagaaagcttcgggagaagaaggcgtgaacatcatagcggctcttctcggattgggtgaactcgtcacaaatgtaaatatgccgaatcaaggccaggtctcaaaccttcctatacaagccattgtcgaaacaaacgcattcatcacaaggaaccgtgtccagccgattttttccggagcgcttccgagaggtgtggaaatgctggcggctaggcatatatccaatcaagaggcagtgtcggaagcaggtctaacaaaggatactggcctcgcgtttcaagctttcctcaatgacccgcttgtcaggattgaccgcagtgatgcagagcagcttttcaatgacatgctccaatgcaccatgcaacgttgagcggagcttttccggtttagaaaagaaaccattgaccatactgatagtataatcaagaagtaggtgctatcaatatgggagattatttaagtgttgcggtagaattggtctgcggtttaggcattttatttattatcttaaagcttctcgggaaaacccaattttctcaaattacgccgtttgactttatttctgctttaattttaggagaattggtcggaaatgccgtctacgatcatgatatcaaaataaaagaaatcatttttgcttcgctgctgtggggcgtgctgatttatgttattgaatttatcacgcaaaaaatgaaatcatcgcgaaagttcttggagggtgagccgaatatcgtcatccgcaaaggagagcttcaatataaagtaatgaagaaaaataagatagacattaaccagctgcaaagcctattgagacaagcggggagtttttcgatccaagaagtagaatatgcgattcttgaaacaaacgggatggtcagcgtgcttccaaaatcagactttgacaaaccgacaaataaggatttgcagattccttcgaagtccgtttctctgccgatcacgttaatcatagatggagagattgtgcgggataatttgaaggaagcaggtgtggatgaacagtggctgaaacaagaattgaaaaagaagaacattgataagacagaggacgtgttatttgcagaatggcataaaaataagccgctgtatactgtaacgtacgaacaaagcagatcaacatgactcttagaaaaaagcttgcagcaaggcgcaagctttttattgattgtatgtcccttgtttgacagcacgtacatggtacatgctcacttcagtgctgatcagatagtcaggctttggtttgcctttgtttgctttatggccggcgatatgcgcatcgcttttttcccattgcttccagtgatcctctgattcccagcgaatcatgacaacaacttcttcatcaccgcggcgcacatttttctcaagcactgtcacatcaattaaaccttcttgtttttcaatgattccttcagcgctgaaacgttctataactttatctgcaaagccttctttaaccgtcatttttctcaactgtacaaacatttgtctcactccaatcattctcacatatgaataattgtaaatgaaattcattctcaatgtcaaagaaagcgcaggacggaatcgaaccgccgtgcgcaacagtttattcttttaataaaaacacatttccgtcttcgtccttaaattgaacgaaggtgccccactccatttgattgggctcaccgagaaattctacaccgtttgtcttcattttctcgtatgtaccaaagatgtcttcgcattcaaacacaatagaagccttcatttgctctgagcctttcatcatggctttcgggtaaatgactaaacgagtctcggccccttttggcgcaacctccagccagcttgcttcaggtcccattgggtggtccgctgcaatatcaaagcctaccttctctgtccaaaattgcttcgctttctgctggtcctcgacatatacagcaacagtgccaatttgtttgatcatagggaaacctccaagttgaaaagataataatactataacctgtttacggccgaagtaacataaaaaaatcagccgggaaaccggctgattattaaaatgagcagcttacaacatcgatgtgatttgtgtctaaggcgaaataaacccagcggcgccgtgaggaatcccaataaaagccgccgacggatcttctgccaaggatgatcgggtaaaaccaaaatgagcggccattggttaaccaaacataggtaaatcggaaaaggcaaggacgaatggtgattggttcaactaacaaaacggctccttgagaaccctgcggttttgggggtttcgctggtatttgggaaggaggaggtccctgcggcgcaccgccgaagcctgggctggcaccgctgccaataccagggccggagccgccgccaaagcctggaacagcgccaccgccaatgccagggccggagccgccgccgaagcccggaacagcgccgctgccaatgccaggccatggatatcggtattcatattcaaaagcaggccaaggctcataaaaatgccccgcaaacatataaggatcaacataatacatgtgataacgtcctttctcattgtaaactgtacattgcagtttatgcgggcggactcttattggtgcattcgcctaaggatatgaagctggaatgctctcagagagcagaatcatttgatttttctctagtcttattcacaattccgatttatcattttataatgaaagtgcttctattacgaaaaaggagacagaccgtgaatatcgatcaattattatatcaatatatcatagacaacactgcggatattactgagaaatggttcagtttgcgttgccagctaaaaggcgagctatattccgccagccatttaagtgaagaaacgaaaacacttttaaccgagcagcatacatttaccaatataacaatcgcaagcgcatttctggaggatcaaaccgattttcaagaaaacatgacaaaatgggcgcaaaacgttgcgaaaaacagggtagagcaggatgttcaagtgcatgaggtcgtagaagccatatccaattcaagaatctcattctgggacgcagtcgccacatttataaaagagaatcaggagattgtgacaaatgaggatgcagaccgatggaaccgcattgtgaatcagtcgttcgataagctgattattgaattctccgagcagtaccaaaaattcatgctgatgaggcttacatctcagcaggaactgatctcagagcttggctgcccggtcatttccattgccgatggaatcgggatattgccgcttatcggctccattgatacaaaacgggcacaggtcattttagaaacagtgccggtccgctgtgtcgagagaaaaatcacaagcctcgtcgttgatctttcgggtgttccgattgtggataccatggtggctcagcaattgtacaacctgtctaaaacacttttcttattaggcgtcaaagccgtattttcaggaattcgcccggatgtggcccaaacatcgattcaattggggcttgattttagtgaatatgaaacgtacggcacgctgaagcaggcattagaaaacatgggtgtccgctgtattgttgaggaattggaagaaaacaaataggaagtttccaggcatatgattgtccgtcaccgggtgatcatatgcctttttgatttgaacagaaatcaccattgatttatcgaaaaaaacataatattataattcttataagaatactgtgaattaaaacctattcaacaggggggaaggtcttttggtttctaaatcaacgattgatccggaagtgattgaaaaaatcatcagctcgctggaaacactcgatttcggcacggttcagattacggttcatgattctcagattacccaaattgagaaaatagaaaagcaccgtttttcgctgaaaaggaaagaatcaaaatgataatgtaaagggcgtttgttttcattaaattctccttaaaacatatacatatttcatccaatttttatataatagacctttaagatcattttttaggaggatttttgacatgcaagctacggttcacgagagtaagcaatcgatcatgcaacgcattttgacagtctttgtcttcacattgctgatcgcgactgtcggcctttttatcggccaatttgttcctgtcgctttgatgctgccgctttctattcttgaagtggcgatgattattctggccttctggatgcgcagaagaaaagcggtcgggtatgcgtttgtatatacattcgcgttcgtttccggcattaccttatttccgatcgtcagccattacgcttccatcgccggcgcctatgtcgtgctcgaagcctttggctctacatttgtcatttttgccgtcttgggcacaatcggcgcaaaaatgaagaaggatttatccttcctgtggtcgtttctgctggttgcggtgctcgcactcgcagtggtagggattttcaacattttcagcccgttaaactcagcggcgatgatggcgtattccgtgatcggaaccatcgtcttttccctttacattttgtatgatttgaaccaaatcaaacaccgccacattacggaagacttgattccggttatggcgttatcgctgtacctagactttatcaacttgttcatcaacctgctccgcttcttcggcattttgagcagtgatgattaatgaaaaagcgcctgtctttggataggcgctttttttccatacataaaaagggcagatggagtattgatgaaaaaacaaatgggcgcatatgcatctctggcagctgctatggcaatcgtcggcagctctgtcgttgtcggcaagctgatggtcgaacggattccggtctttctttcctccggattgcggtttttgatcgcttctgtcgtattgctcacgctgctgttttgcattgaaaaagggtttccggctttgacgaaaaaagatgtgctcgtattgctggtgcaatcattcacaggcgtgtttttgttcagtatttgcctgctgtatggggttcaatatactacgggaacggaaagcggcattttgacaagcacaacccccatggtgatcggtattttatcctttttcctgctgagagaaaaaattgagaaaaagacgctgatcggcattttgctggcggtttgcggcgtaatggcgattaatctgtttggagcggggagccaagacgggacgccgcacgccttattcgggaacatgctgatcattgctgcagtcattggcgaagcgttgtttacattgatggccaagctgctatccccgcatatttcggcactggcgatttcgaccttcgtatcgctcttcggcttcctgttttttctcccgtttgctttgtttgaggcctcttcatttgattacagcgtgccgactgttttggattggtcgtatgtgctgtattacgcgctttttgtcactgttttggcgttttacttatggtatagcggggtgacgaaggtgccggctggggtgtctggcattttcacatcctttcttccggtctctgctgtcattttggcaggcgtgatattgaaggagccgtttgagcttgtgcatttgattggcattgtatgtgtcatcggcggcatatttgttacggtcataaagaaaaaacagccggatgcgtatccggcttcagaagaaaagacgctgtagcctgtccagatcggacgggttttttagtctttaaacacgctcagcctttcaaaaagatcaccaagcatctttacgaacatgtctttttcctcgtcgctgtagttttccatgatcgctgagattttgctgaaatggccgggcagaaattcctcaaggcgtgctttgccttccgttgtcagttcaatgctgatttttcgtttatcctctgtgtgatgcctgcggctgacaaaaccgtccctcgccagcccgtccagcaggcctgtaatcgtcgctttcgtgacgtttgaccgcttggcaagctctgtcggacttaacctatgatccttggcatcaaagagcagcatcaggattttgaattttccttctgacagccctcggccagcaaagtaatgctccatcacatgattcattttttttgaaatatcaaaaagagataaaaacaattcaagagagccggcgtcaatattggcatacgtttcggcgtgctctgttatatgcttatatttcggtaaatgttttaattccatcgcaagtagctcccgtacattcgttgtgacacgattataaaggagggaaaaccataacgcaacttggcttggagatgattgacagattttcttgggacatagtaaggtaatatagttaggcgcctaactaatgcatatagagctgaaaaggtggttattgatatgaaacatatgttaattgcaggaggcggcatcggcggcttatcagcggccatttctctccgtaaggcagggttttccgtcaccttatgtgaagcggcttcagaaaaccgaaaaacaggtgcggggattcttcagccgcaaaacgcactggcggtgttgaaagaactgggcgtattcgaagagtgctgtaagcacggctttcaaacagaatggtttaaaacgtttgatgaacaggggaatttgctgtttcaagtcagtgaatcctttttagacgattcacttccgggacgcaataatatcctgcgcaaaacgttaaatgacattctcatgaagcatgccgaggcagtgggtgtagacatcaagtgggggaaaaaggttgtcgcttatgaagaaacagctgaatcggtcactgccgtatgtgaagatggggaaaagatgcaggctgacattctggcgggctttgacggcattcactctgctattcgcgatataatgctgcaaaaggagacggaaaaagagcatctcggcatgggagcgtggcgcttttatatcgaacttcctgactttacatttaaggacgcaacattcatgtatagaagcggagacacacaaatcggggtggtgccattggcggaacacgctggctatgtcttcgtcctccagccttgcacgagcgattactgggatgaggaagatacccggtttgatagagtaaaagagattctttctggttttcgggggctggattttgtcacaaagcacatgtcaaaacagcatcctgtcatctttaacaaactggagcaggtcgccgtgcaggagccatggcacaaaggccgcgttgtcatcggaggagacgctgcccacgccggcgcgccgaccctggcgcaaggagcggcaatggcgatcgaggatgccatcgtcctcgccgaagaactccaaaaccacgccgaccacgaaacagcattacaggcgtactacaaaagaagagcaccaagagcgctcaaagtccagaacctatcttcagaaatcgtccgccgcgggctgaaaggagagccgggagcggaagaactgattggggagtgctatgcggtgttgagggaaggatattaaataggaaaagtccagaaagtgatttctggacttttttattcttgctctgttttattccttatccgctcaatcacctcatgcagcccctcaggcttataaaactccaccggcgaactgcctttctcaaacgaaatcgtctcggcttcaatcagcgcgacatagcgcccgtttacttttgcgagatgaatagaatcgccaaaatccgctagcaatcccttaatctctgtttctccgactttcattttcagctgggcctctggcgtgtgctcgatgatttgggcggaggcttcgatgacttgatgggtgtcgaggcgctcttggatttcccgtttttcgcttgcttcccaaatctcaatgtcgtgctcgaactgcttgagctcttcgctgttgtcttcaaatgtctcgtagacgtgctcctgtaccatgttcatgacctgatttttcatgatttccggcatcgattctccgtactcgacgaatttcagaaagtcctcaaaatagcgggcgtgcgaagcctggtggattttcagctcaccttcctcgaccattccttcctctggcatgtacgggtattggatgcttttcatgttttttgtcgtgatcgccatttcgacttttttaatgagagaagacgcgtcagagatgcgggcgaccttcggctcaaaatcacatttcataatgaagacaaatgactcgtcaaagtattttctcggcacggccgaagcgacgagaaacacgccgccgcgaaccgcgcttgtgtcgaggtacgtgcggacgaactgctcactcagctcattgaagtcttcttttgtttccgccagacgcgcgcggttgaacatgttgtagtttgggttggaatcgagctcgtggccgggctcgacgataaaatggccgattttcgtcgggacctgctcggactgcggatggcggtcggctttccgtttgacgatttttttcagttccccgtcgagaaagtccttcagctcgctttcttcaaattcgcccgtatcaagggtctggaagtgcttgaactgcttgttcgcctgctcatctttgccttccacctgtatgacataaaaggataaaaaccgaatttcaaaatccatatataaactcaccttattcgcgtattgtacagcttctcaagtatagaaaaaacagcgatcatgcgtcaattgggagaataatcatgaccatgaaagggaaatgtaatcaaatagaaggcatctcatacggaaaggaatggttcgatgaaggaaacaagcccgattcctcagccgaagacgtttgggccgctcggcaatttgcctttaatcgataaagacaagccgacgctttcgctgatcaaactggcggaagaacagggcccaatttttcaaatccatacacccgcgggcacgaccattgtagtgtccggccacgaattggtgaaagaggtttgtgatgaagaacggtttgataaaagcattgaaggcgccttggaaaaggttcgcgcattttccggtgacggattgtttacgagctggacgcatgagcctaactggagaaaagcgcacaacattctgatgccgactttcagccagcaggccatgaaggactatcatgagaaaatggtcgatatcgctgttcagctcattcaaaaatgggcaaggctcaacccgaatgaagcagtcgatgtcccgggagatatgacccggctgacgctcgacaccattgggctatgcgggtttaactaccgctttaacagttactacagagaaacgccccacccgtttatcaacagcatggtgcgggcgcttgatgaagcgatgcatcaaatgcagcggcttgatgttcaagataagcttatggtcagaacaaaacggcaattccgccatgatattcaaacgatgttttcgttagtcgacagcattattgcagagcgcagggcgaatggagaccaggatgaaaaagatttgctcgcccgcatgctgaatgtggaagatccggaaacgggtgaaaagctcgacgacgaaaatatccgctttcaaatcattacgtttttgattgccggccatgaaacaacgagcggcctgctttcctttgcgacttactttttattgaagcatcctgacaaactgaaaaaggcgtatgaagaggtcgatcgggtgctgacggatgcagcgccgacctataaacaagtgctggagcttacatacatacggatgattttaaatgaatcactgcgcttatggccgacagctccggctttcagcctttatccaaaagaagatacagtcattggcgggaaattcccgatcacgacgaaagacagaatttctgtgctgattccgcagcttcatcgtgatcgagacgcttggggaaaggacgccgaggaattccggccggaacggttcgagcatcaggaccaagtgcctcatcatgcgtacaaaccattcggaaatggacaacgggcctgtatcggcatgcagtttgcccttcatgaagccacacttgtgttaggcatgattctaaaatatttcacattgattgatcatgagaattatgagcttgatatcaaacaaaccttaacacttaagccgggcgattttcacatcagggttcaaagccgtcatcaggaagccattcatgcggacgtccagacagctgaaaaagccgcgcctgatgagcaaaaggagaaaacggaagcaaagggcgcatcggtcatcggtcttaacaaccgcccgcttctcgtgctgtacggctcagataccggcaccgcagaaggcgtcgcccgggagcttgctgatactgccagtcttcacgacgtaaggacagagacagcacctctgaacgaccggattggaaagctgccgaaagagggagcggttgtcattgtgacctcgtcttataatggaaagccgccaagcaatgccggacaattcgtgcagtggcttcaagaaatcaaaccgggtgagcttgagggcgtccattacgcggtatttggctgcggcgaccacaactgggcgagcacgtatcaatacgtgccgagattcattgatgagcagcttgcagaaaaaggcgcgactcggttttctgggcgcggggaaggggatgtcagcggtgattttgaagggcagcttgacgagtggaaaaaaagcatgtgggcggatgccatcaaagcattcggacttgagcttaatgaaaacgcagataaggaacgaagcacgctgagccttcagtttgtcagagggctgggcgagtctccgctcgctagatcgtacgaagcctctcacgcatccattgccgaaaatcgtgaactccagtccgcagacagcgatcgaagcactcgccatatcgaaattgcattgccgccggatgttgaatatcaagagggcgaccatcttggcgtattgccaaaaaacagccaaaccaatgtcagccggattctccacagattcggcctgaagggcaccgaccaagtgacattgtcggcaagcggccgcagtgcggggcatctgccattgggccgtcctgtcagcctgtatgatcttctcagctacagcgtcgaggtgcaggaagcagccacaagagcgcaaatacgtgaactggcggcatttacagtgtgtccgccgcataggcgtgaattagaagaactgtcagcagagggtgtttatcaggagcaaatattgaaaaaaagaatttccatgctggatctgcttgaaaagtacgaagcgtgcgacatgccgtttgaacgatttttagagcttttacgtccgttaaaaccgagatattattcaatttcaagctctccaagagtgaatccgcggctagcatcgatcacagtcggcgtcgtgcgcggccctgcgtggagcggccgtggcgaatacaggggcgtggcatcaaatgatttagctgagcgtcaagcgggtgatgatgtcgtgatgtttatccgcacaccggaatcccggtttcagcttccggaagaccctgaaacgccaatcattatggtcggacctggcacgggagtcgcgccattccgcggtttccttcaagcccgcgaagttttaaagcgggaggggaaaacgctcggtgaagctcatctctattttggatgcaggaacgatcgtgattttatataccgcgatgaacttgagcagtttgaaaaagacggaattgtcactgtccacacagccttttcccgcaaagaaggcatgccgaaaacgtatgtccagcatgtcatggctgaccatgcagaaacgttaatatcgatccttgaccgcggaggcaggctttatgtatgcggtgacggcagcaaaatggccccggatgtggaggcggcactgcaaaaggcgtatcagtctgttcatggcaccggggagcaagaagcgcaaaactggctgagacatctgcaggataccggtatgtacgctaaggatgtctgggcagggatatagataaagaagactggagacatccagtcttttttgtcctttagaaaaaatggtgatcgcgctaaacattgatgcatacaataacttcagtccgccggaagggcgggctgtctgcaaaacctatttttcgtttttgctagtttatgttattcttatactcggtatctatttcttttttcaaaggcacacatgacaaaagaaatcctttttttatttccgagaaaaaaatgtgaaacgaaatgaaggtttctttcgtccagtgattggtttccaaatggttgtaataaaaatgatatggtgcgaaacataaatattccggcttgccgcggtgtatttcttgttgtgtgatgccttgattttgtttggaaagaaggaattggaaggcaggatataaagagcaggtaaatatgaatgaagaacttaaagtgtttaagaaagtagaggttgccatgaagaaacttttttcttacaaacttagcttttttgtgctggctgttatactgttttgggcaaaaacgtatttatcctacaagactgagtttaatcttggggtaaaaggcacaactcaggagatcctcctgatatttaacccattctcaagcgccgtcttctttttaggactggctttgctggcgaaagggcgtaaatcagccattattatgctgattatcgatttcttgatgacatttgtgttatatgcaaatattttattctatcgtttctttgacgatttcttgacgttcccgaacattaaacagtccggaaacgttggaaacatgggagacgggattttcagtatcatggccggtcatgatattttctatttcttagatattatcattttgattgcggtattgatctggagacctgaattaaaagaatacaaaatgaaaaaacgctttgcgtctttagtgatcctttctgggatcgcactgtttttcatcaacctgcactatgcggaaaaagaccgtccgcagctgctgacaagaacgtttgaccgcaattatatcgtgaagtatttaggtctgtacaactacaccatttatgacggtgtgcagacggctcaaacagaaacgcaacgggcctatgcaagcagcgatgatttaacaagcgtcgagaattacacgacgtctcattatgcgaaaccaaacgccgagtacttcggctctgccaaacgcaaaaatatcattaaaattcacctcgaaagcttccagtcattcctgattgactacaagctaaacggtgaagaggtgacgcctttcttaaataaacttgcgcacggcggggaagatgtgacgtattttgataacttcttccatcagacaggccagggaaaaacatctgatgccgagctgacaatggataactcgatcttcggtcttcctgaaggctccgcgtttgtgacgaaaggcgaaaacacttaccaatcgcttcctgcgattttagaccagaaggaaggctatacaagcgccgtcctgcatggtgattacaaatcgttctggaaccgtgaccagatttacaaacatatcggatatgacaagttcttcgacgcaagcacgtatgatatgtcagatgaaaatgtgattaacatgggacttaaggataagccgttctttacagaatcgattccaaagcttgagtctcttaaacagccgttttacgcgcatttgattactttgacaaaccattatccgtttaacctggatgaaaaagacgcgtctcttaaaaaagcgacaactggcgataacacagttgacagctacttccagacagcgcgttaccttgacgaagcgcttgagcaattcttcaaggagctgaaggaagccggcctgtatgacaactcagtcatcatgatttacggtgaccataacggtatttctgaaaaccataaccgagcgatgaaagagattcttggaaaagagatcacagattatcaaaacgcacagaaccagcgtgtgccgctgatgatccgcgttcctggcaaaaaaggcggagtgaaccatacgtatggcggcgaaattgacgtcatgccgacacttctgcacttagaaggaattgattctcagaaatacatcaactttggtactgacttattctctaaagaccacgacgatacagtggcattcagaaacggagacttcgtaacgccgaagtacacatcagtcgacaatgtcatttatgatacgaagactggtgaaaaactgaaagcgaatgaagaaacgaagaatctgaaaacaagagtgaaccagcagctgagcctttcagacagtgtcctgtacaaagacttgctgaggttccataaactaaatgatttcaaagccgttgatccgtcagactatcattacggcaaggagaaagaaatcaaataagatgaaaaagagccttgagcgggcgcattgccttcgctcaaggctcttttttttggttatacaaccaacttgaaaaaatagattccatttggtcaccaaggctggctttctctcatatcattacagtagattttgaaaccggtattgaaatcggacaaattatcggggaaatgccttgatagattgtgaagatgtaccaggtttcgaactcaatattcatagagatgaggggtagagatgaaagcggtcattctctgcggcggaaaaggaacgagaatgagtgaagtcacgaatgacattcctaaaccgctcgccatgataggcggcaaaccgattctatggcatattatgaaaatttatcagtactacggagtaaacgagtttattctgctgttgggctataaaggagaaaaaatcaaggaatactttctcgactatgaatggaagcacaacagcctgacactcgacagctctacgggagaggtacagatcctggggcagcctgaaacgtggaaaattacgtttttggagactggggaagatacgctgacagccggaagaatcttgcaggcgaaagactatatcggtgatgaaacatttctgctcacctatggggacgggctggccaatatcaatcttttccatctcatcagctatcatcagacaaaaggtgttgccgcgactgtcaccggcattgacaaagtctcgcagtttggcaccttgacggttgaggacggcatggcgaaaacattttctgagaagacatcaagtgacggaatcatcaacggcggattcttcgttctcagtccaaaggttttcgagtatttgccgaaggacgggaacgcgatgttcgaagatgaaccgctgaagaaccttgccaaagacggggagcttgctgtgtaccgccattatggattttggacggccatcgatacgtataaaaatctcttagaagtcaacaaaatgtggaatcaaggacaacaagtatggaaggtatggtgaatcgatttgagtttctggaaaaataaaaacgtatttgtcacgggatgcacaggtcttttaggaagctatttggtgaaagagctgatcgatcagggcgcaaacgttacggggcttgtcagggatcatgtgcctcaatccaatctttatcagggagaacatatcaagaaaatgaacatcgtgcggggctctcttgaggacttggctgtgattgcacgcgcgcttggcgagtatgagatcgacactgtctttcatcttgctgcacaagcgattgtcggcgtggcaaaccgcaacccgatttctacctttgaagcgaatatcctcggcacctggaatattctcgaagcctgccgcaagcatccgttaattaagcgggtcattgtcgcttcaagtgataaagcttacggcgatcaagaaaaccttccatacgatgaaaacatgccgctgcaaggcaagcacccgtacgacgtctcaaaaagctgcgcagatctgatcagccacacctattttcacacgtacgggcttccggtctgcattacgcgctgcggaaacttatacggcggcggagatttgaacttcaaccgcatcattcctcagacgattcagcttgtgctgaacggggaagcgccggaaatccgaagcgacggcacatttgtacgggactatttctatattgaagacgccgttcaggcttatctgcttcttgcagaaaaaatggaagaaaacaatcttgccggagaggcctttaacttcagcaatgagatccagctgaccgtacttgaactggtagagaaaatattaaagaaaatgaacagtaatctgaaacctaaggtgctgaatcagggaagcaatgaaatcaaacatcaatatttatccgcggaaaaagcaagaaagctgctgaattggacaccggcctacaccattgatgagggacttgaaaaaacgattgagtggtatacggaattcttcaaaaagtaatgtgaaacgaggtgaacaagactgtgaccagcgcgtattgcaccgttttatcaaaaggaagattatatcaggcagtcgctttgtttaagtcgttagagctagttgatcaagacagtcccatttttatactttgcatggatgaagatacgcaccgcgtgttacagaagctgaagatgaagcagctgaaccttgtgccggtggccgctcttgaaaatgaattgcttctgaagctgaaggaaactagagatcaaagtgagtattgctggacgatgaagccgatctttctgcaagctgtgctgaatagcaatcccgggctggagcgtgtgacgtatattgacggggatctctttttctatgcagatccatcgccgatttttgaaaaccagccggactgctcggtgctgctttcacggggggatattgtaatcccttcttttgagaaagagcagattgacatgctgcagcgtcttttaggcagatataattccgggtttattagcttcaagcatgatgatgcaggcacggattgcttggagtggtggaaggaacgctgtcttgaggaatgcaaaaatgcaccgggtgaaggaaaattcggtgatcagggctatttggattatatgtctgagctgtttccgaatgtgtgtgacattacaacacccggcgtgaacatcgggcattggaattatgggcagcatacgttttcctggaaagatggccggatcgtgctggaggatggcagtccgctgatcttttatcatttcagcggataccgaatcgtcagcatcaatgaaatcaaacagattcatgaaacaacccgcacagatctgccgtttgtgcatgaactgtatcaagagacactgccgcatatcattcagcacatcaaaacgttagaccctgaatttaacggttttgcttcaaaagatgacaacaaataaatgagtaaatacaggaagtgaaaatgaagtgaaagcaagcgttattattcctgcatataattcgaaggagcgtctttacaacagccttctgtcattaaaccagcaggagtgcgatgaagaattcgaagtcattgtagcggacaatggctctgaggacgggacgctctcgatgcttgagtcatttcaagctgattttccgctgatctttacacggattaaagaaaacaggggcattgcgtacggacgaaatcaggcgcttcgcaatgccagaggagacatcctgattttccatgacagcgatatgcttgcggcaaaggaccttgtggcaaaacatattaaagcccatgagaacgaagagaatctcgtcgtgtgcgggttgttttggaaacggatctacagtttttattatgaacggtttgaagaagaacataaggaacagctcgcaaagctcacaggtgaaatgtcgaagaaagacaaacaaaagctgctggaggaggcggacatcaaaaacggaagctttcttgataaaagctttgacctcgataccgactttatagacgtgctcaagaagattttagatgagtacggcgatgacttgaaaggctatcatatgccatggcgcttttttatcacgaataattcctctgtgaaacgcaagcatgtggttgacctcggtttatttgacgaaggcattgtgcggtacgggtttgaggattatgacctcgggatcaggcttcatcaggccggattgaccttcaggcttcgccgcgatattgtcagtgttcatcaggaacatccaagcaattgtaagtctgtagatgatattcgggccaacattgcctatatgtgcgataaatacaataacatccgctccttagacgttcatctcgcttttaatggaccgttcccgcctgacatgacgaacagaatcatgactgatattcaaaagctgctggagtctcagaaatatgatatgctgctgaatctgtttcttgagcttctacatgttgttaaagagcgcaacattgatccggattggcgaaagaaagccccaagggtgacggcgaaaagctttgatttacaaactgtccgcaagcttctgccaaaagcgaagaaaaagctaggcgtgaacgattttgccaacgcactgtatgcgcttgtcaacgatttgctgcacgtggatcttagatcattggatgtggtataagtgagtacatttcatttttcaacgatagtgtcaaggacacatatctttaagctcatgcctatgattcattctctccatgagcattgcgatgattttcatttatatgtgctgtgtgtcgaccagaaagcgtatgaattgcttcagcacgtgccatgggagcatgtaacctttgtgcagctgcatgaaatggaagacccggagctgctgaaagcgaaaagcaacagaacgtttcatgaatattgctggacgttaaagcccgcctttttgtttcatgtgatgagcaagtgggatgacgctgaatactttgcccatatggatacggatctatttttcttttctgatccggcgcatatttttgcagaaaacccaacggcgtctctgtatttgactgatcatcgtaattcgccgcgcttcatgtcctactacgaccgaaccggacgctttaatacaggctttgtcggtgccggtaatacaaaggaagcatatgaagcggtgtggcagtggagacaggactgtattgaattttgcacggtcgaaatggatacggaacgaaagacatatggtgatcaaagatatgtggagaaatggccggagcagtttaaaggtgttcatgttgtcaaatccataggagccaatacagcgctttggaatatcgaaaactataaggtcgggcaaaaggacggccgcgtgtatatagatgaaacgccgctgattttctatcatttctctgggtttacactggtgacagaaaaagagtttaatctttgctggtactatcggattgaagacgaagcgacaattgagatgatttatatgccgtatatattaaatctgaaaagatggattgatgaaatacagtcggcgtttccggactttgcggatggctttatcccgaagcacgcagtgcctgacactcattttatccagctggattaaaaaacccctgccgcctggcaggggttttttcagctatgccattctctcagcttctggtcacttggcaataggaaggcaaggatgccgagaacagggagaaaggcaatggcgatcatcgtcggggtcagtcccgctgcgtcaatcagagcgcccagcgccacagcgccgatcgcgcccatcccgaaggcaagcccgacggttaaaccggacattgtgccgatttttccaggaactagctcctgtgcgtagacgaccgttacagaaaagctcgacatcagaaccaagccaatcaatgcgagcacgccataggcgagaaccgggccggcaaatggcagcacaatcgccagcggcgccgagcataacagcgaaccgaggataacgaagcgttttccaaaacggtctgcaagcgggccgccgagaaacgtgccgattgcaccgaacagcaagaagacaaaaatatagctttgtgcctgctgaatgcttacgtgataggtatccatcgcgtaaaacgtgtaaaagttaccgatcgcactcgtataccaagaacgagcaaaaatgagaaatataataataataagagcagatacaacagatttggtgatggccgtgttttcagccgttttcttttgtttgcctgatttctgggcaaggctgccgagacgtgaggcgtaccatttcgcaatatacatgagaaacaaaacagcaagcgcggcgacaagcgtgaaccaaacagcgccgaattgcccgagcggtacaaggatcagcgcggtgatcagcggcgccatcgcctggcctgagtttccgcccacctgataaatcgactgggcgagcccgcgttttgtgccggcggccatatacgccacacgggagccctccgggtggaaaatggccgagcctaatccaatgaaaaacacacagcataggatcgttatgaatgacggggcaaatgcaaggcctaaaatgccaagcatgctggcggtcaaaccgactggcagcgcatacggccgcggccgtttatcggtataccagccgacaacaggctgcatgacggatgacaccatgtttaatgtgaaagcgatgatgccgagctgtgtaaacgtcaggctcatggagcgttccaaaatagggaacatggccggaatcacagcctgaagcgaatcgttgagcatatggcaaattccgataataatcaaaatcggatacaccgtggtgcctggtttttgaactgttttttcttttaacggggcggcgatagccaattgagtctcctccttacatatataaccaaagcataccaccatattattcataaggtgaagaatttatcaagaggaaaaaagattcttatgaaagaaataccgtcagcctgattaggagctgacggtattttcgatattcaaaatgtgatatagctcttcaagcttacgaatctcataggttggtatgatctctggcacattcggcttcatgtcagggttcatccaacaagtgtcaagtccggcgagctgtccgcctttgatatcagcagtcagtgaatccccaatgattaatgtgtgctctgctgaaaattgaggaatccgttcaaatacgtaatcgaaatattccttcatcggcttttggaagcctgtgtcttcagaaacgaaaatgtccttgaagaatggaaataatcctgaatcacggagacgcttatattgtgtgttagacacgccgtttgtcacgatgtacaaatcaaactgttgctgcagatttgagatgagatcaaatgcaccgtcaataagctgatgtccttcttcaagaaagcggcggtatttttgctcaagcaaagcgccgtccgcttcgtaaacgtactccttgagcaaagcggagaaacgtgtgtttacgacttcatcccgtgtcatcttaccttcttcaaaggctctccagagaccttgattgctggttttatactgcgccttcatgtcatttgttaaaggaatgttctgatcttcaaacagcaaacgcagggctaaagcttctgccgcttgaaaatcaaggatggtatcatctacatcaaataataaagtgcggtatcgtttcatctgtgtgtctccctttctcatatgtattcaaagtatagcacataaaaaaaggaaaaagccggcgggtgaggcaccgccggctgaaaagagattatttgtttaataagctgtgttttctcgaatataggaagtaaaccagcgttccgacagcgatccagatgacaaatgaaagccatgtgacgccgggaaggctgtacatgaaccaaaggcagatgcctgcgctgataatcggcacaaccggaacgaacggcactctgaaggacgccttgatttcaggatgtttctttcttagcacaatgacagcaatagatatgaccgtaaacgcggcaagtgttcccatgttcaccagatgggccagcgttccgaggttaataaagccggcgattcccgctgcaacgatccctgtcagccatgtgttgcggaacggggttttaaatgacggatgaacctttgcgaacaatccaggcagaaggccgtctctgctcatggcaaatgtcaaacgaacctgagcgtacagcaaagcgagcatcaccgtcgtaatcccgataatcgcaccgacagaaataattccggcaacagcgtcctgtccgacgaatttcagagcaaaggatacaggatctccgacattcaatttggcataaggcatcatgcctgtcagcacaagcgataccgcgatgtacagaaccgtgcagacggctagagctgaaataatgccgacgggcatgtttttttgcggatttttcacttcctctgacgcgttagaaaccgcgtcaaacccaaggtacgcgaagaatacagtggcggcgctaagtatgacgcctttcatcccgaaaggcataaaaggagaccagttatccggtttcacatagccgatgccgacaataatgaacaataatatgatcgcgattttcatcagtacgatgacgttgttaaagcgtgtgctttccttgacgcctctgctgacaatcgcagtgatgaggagaatgatcaccgcagccggaaggttaaatacggcgcccgccgtgcttcccggcgctcctgtcagtgcagccggaatatgaagattgaagccggcaagcagtgattgaaagtatgaagaccagccggtggcaaccgccgacagtgcaatgacatattcaagcatgagatcccatccgatcaaaaaggcgagcagctctccaagtgtcacgtatgagtaggagtacacgcttcccgaaatcggaatggaagacgaaaactcagcataacagaaagcagccagcgcacaggcgagccccgctaaaataaacgatatgatgagggcgggacctgcaccggtcgctgccactgttcctgtaatgacaaaaatccctgtaccgatgacacaaccgataccgagcaaggttaaatcaaatgcgcttaacgtacgggcaaggctttttgacttgctctgcgcactcaatgtttcaagcggtttttttctaaataatgaactcatcaaaagttcctcctgtaaatattcaaaatattctaatcattatatacagttcttgttgtattatattgtcgaaatttgacgcagtcaataaaatatttttctgctttaaatgatagaagcgaaacagcgttgtcgtatcataggatagtaatttttactaatcgtatattcaattttatgcaagatgaaccgatagaaaaaatagattcgcccatattttgatttgcggttataaaggagatgctgaccatgtttcaatatgaagagttgaataaacagtttatcggcgggaaatggcaggagggcagcagcccaaatgtattggaaaacaaaaatccttatactcaaaaaacattcacaacattccgtaaagcgactgctgacgatgtagatgaagcgtatcgggcagcggcgctggcaaagaaaaaatgggatgcggtcaacccgtttgagaaaagaacaattttagaaaaagccgtcacgtatattgaagaaaatgaagaagccattatttatttaattatggaggagctaggcggtacaaggctcaaagcggcttttgaaatcggacttgtcaaaaacatcatgaaagaagcggcaacgttcccaatccgcatggaggggaaaattcttccgtccacaatagatggcaaggaaaacagattatatcgtgtgccagcaggcgttgtcggtgtcatcagtccgtttaacttcccattctttttatctatgaaatcagtggcgcctgcactcggagccggcaatggcgttgtgctaaagccgcatgaggaaacgccgatttgcggcggaacgctgatcgcgaaaatttttgagaacgcgggaattccagcggggctgctgaatgttgttgtcacagacattgcagaaatcggcgacagctttgttgagcatccagtgccgcggatcatctcatttaccggttctacgaaagtcggcagctacattggacagcttgcgatgaagcattttaaaaagccgcttcttgagcttggcggaaacagcgccttcatcgtactggaggatgcagatatagaatatgcggtcaatgcggcggtgttcagccgatttacacatcaaggacagatttgcatgtcagccaaccgcgtgcttgttcattcttctatttatgacaagttccttgagctgtaccaggcaaaagtggaatcgctgaaagtcggcgacccaatggatcctgatacgattatcgggccattaatcaacagcagacagacggacgggctaatgaagactgttgagcaagcaattgaagaaggcgctgtaccagtgaagcttggcggatttaacgggacgatcgtggaaccgacgatcttaaaagacgtcaaaccgttcatgagcattgccaaggaagagctgttcggaccagtcgtctcctttatgaagtttgattcagaagacgaagcggtggatatcgcaaacgaaaccccgtttggcttgagcggtgctgtacatacgtcaaatcttgagcgcggcgtggcatttgcgaaacgcattgaaacaggcatgattcacgtcaatgacacgaccatcaatgatgaaccgaatgtagccttcggcggtgaaaagcaatcaggcctcggccgtttaaatggtgagtggagcctcgaagaatttacaacgctgaaatggatctcggtccagcacgaaaaacgcagcttcccttattaatgaaaaggagtgaatggaattgaccataaatacggaaaaagaaaccgcagatattctggacgcatttatcaaagtagccccttatttaaacagcctggttcaggatgatattacaatcggcatttatgatacggaaaaactgctcgtgaatataccggccaaaaccttttcgctgaacgtaaaagccggcgatccgctgcaggaaggggatatcatcacagatgccatccgaagcaatcagaagaagacgagcatggttccgaaagaattgttcggcttcccattgatcgcgcgtgccatcccgctgcacgacgagaatggaagagtcattggaggcgtcggcctcggaacgagccttgaggagtcgtcaaagctgcatgatgtcgcggaaagcttatcagctgtcgttgaacaaacagccgcggctatttccgacatttctgaatcaattaacgggttttcaactcaaatgtcgggcatttcctctcaggcgaaaaaagtaagcgaaagcgccggtgaaatcgccgatatttcagtaactgttaaaggcatctctgaccaaagcaatctgctcggcttgaatgccgcgatcgaagcggcaagagcaggggagtccggaaaagggttctctgtcgtcgcagatgagatcagaaagctagcgacgcattcaaaagaaaatgtcggccaaattgaccagattacgaaaaaaatccacagcctgctgaaagggctggaggaatccattgagtcgattaaccagcatacagacggacaagccgctgccgttgaacaaatttccgccacgatgcaggagatttcaggaagcgcgcagcatcttgcaaaaatggctgaaaaagcgcttgaggaagagtaagagaccggggacaaacatccccggtctttttcttatcctgcatttccatgaaattcgtctgacgttttactagttttattccagcggctgatttaaaatgtacacatgaacttacgtgaggattgataggaaccatgagcatattaaaagcggaaaatctttataaaacatacggagataaaacattatttgaccatatctcctttcatattgaagagaatgagagaatcggattaatcgggccgaacggaactggaaaatcaacgctgctgaaagtaattgccggcttggaatctatcgaagaaggagaaatcacgaaatccggaagcgtgcaggtcgaatttcttcatcaagacccggagctgcctgcggggcaaacagtgctggagcatatctattccggtgaatcggctgtgatgaaaaccttgcgtgaatatgaaaaagcgctgtatgaactggggaaagatcccgaaaatgaacagcgccagaaacacctgctggcagcacaagcgaaaatggacgcaaacaatgcatgggatgcaaacaccttggcaaaaaccgtattgtctaagctgggcgtcaacgacgtaacaaaaccggtcaatgagctctcaggcggccagaaaaaacgggtggccattgccaaaaacttaattcagcctgctgatctgctcattttggacgagccgacaaaccatttggataatgaaacgattgagtggcttgaagggtatttaagccaatatcccggcgccgtcatgctggtgacgcacgatagatatttcttaaaccgtgtcaccaaccgcatttatgagcttgaaagaggcagcctctacacgtacaaaggcaactatgaagtgtttttagaaaaacgtgcggaacgggaagcgcaggctgagcaaaaggagacgaagcggcaaaacctgctgcgccgcgagctggcctggctcagacgaggagcgaaagcccgctcaacaaaacaaaaggcgagaattgaccgggtagagacgcttaaagagcagaaaggccctcagtcatcaggttcactcgattttgccattggctcgcaccgtctcggaaaacaggttattgaagcggagaacgtcatgatcgcttatgacggccgcatgctcgtcgaccgttttaatgaacttgtcataccaggtgaacggatcgggatcatcgggccgaacggcatcgggaaaacaacgctgttaaatgcccttgccggccgtcatacgccggacggaggcgatattacgatcggacagacggtcagaatcggctactatactcaggatcatagtgaaatgaacggtgagttaaaggtcattgactatataaaagaaacggcggaggtcgtaaaaacggcagatggcgatatgattacagctgaacaaatgctcgagcgtttcctcttcccgcgttcaatgcagcagacgtatatccgcaagctgtccggcggggaaaaacgccgtttatacttgcttcaggttctcatgcaggagccgaatgtcctgtttctcgatgagccgacgaacgatttggatactgaaacattaagcgttcttgaggattatattgaccaattccctggcgtcgtcatcaccgtatcccatgaccgctatttccttgaccgcgtcgtcgaccgtttgattgtatttgaaggaaatggcgtcatttcccgctttcaaggctcctatagcgactatatggaggagtcaaaagcgaaaaaagcggcccaaaaaccgacagctgaggaaaaaacggctgaagccgagccgaagaaaaaacggaaaaagctttcttacaaagaccagctggaatgggacggcatcgaagataaaattgcccagctggaagaaaagcatgagcagctcgaagctgacatcgccgcagcaggcagtgattttggcaaaatccaagagctgatggccgagcaggcgaaaactgcggaagagcttgaggctgcgatggaccgctggacagaattgtccctcatgatcgaagaactggaaagctaaaaagcgtggccgcagcaggccgcgctttttttcacataatggacaaaaacgaaccggcctgcttatgttaggataaaattgtgtgtcagcggcacatggaaaactaacggagatgatgaagtatgacatgggcgatcgtgatgttaattctcatgagtctggtgaaaatcgtattaacctgtcttcctacaggcgtcatagaatggctgctcggcaaatttgaagtgcacgccaagcttagtggcgaaaatgcgagtctctctctagatggaaaacgtctcgagggtacagagaagcagaaagtgattgatcaatttaacgaagctgtcttcctggagaaatattatatctatccaggtgatgaagagcgttatttacatccggaaaatggcggcacgccgctggtgatagatacaaaaaaaggaaaaaaagacgtgaagctgttcgtgtaccgctacgacgaccatatcgacgtcgtgaaacagtacaagaagaaagtgatcgcgtatcgagtgctttctgaaagccttcaaaaagagtctctgtcagtggcgggaagtttagcttaaacaggaaagtgaaagacgggtgctttatgctgctcgtcttttttattgttttttaaaacttaacgtttacgttaaggttcaaaaggtgtataatggtaacagaaacggcgaagggggatttaccttggaatggatgaagattgatcaagtggccaaaagaagcgggctgacaaagcggaccatccggttttatgaagaaatcggcttgattccggcgccgaaacggacagacggcggtgtaaggctttattcagaggatgatatggaggagcttgaaaaagtcatcagcacaaaagaggtgctcggtttttcccttcaggagcttcagcatttcatggaaaccagccgccagctagagttaaacaaagaggggtatttgttgtcactggatcctaaggaacggaaagaaaaactggaggaaattcaggaaaccctgaatcaccagctgagtttgattgatgagaaaatccgcacattccaaagctttaaagaacgcctgcaaggcatgaaaggcaaagcggaacgcgccattcaatcaatcgaatgaaaagtttgttaaacgctatttttgtagcgtttcttttaatggaataaagatggaggttaggtcaaatggataagacaacacaagtgaatcagaaaacaggcttgctcagccagccaaaagcggtatgggctgtcgcatttgcctgtgtgatttcctttatgggaatcgggctggtcgatccaattcttccggccattgccgcacaactacatgcttcacctagtgaagtatcactcttgtttacaagttatttgcttgtaaccggatttatgatgtttttctcaggagccatttccagccgcatcggcgcgaaatggacattaattctcggacttatttttattattgtgtttgcggggcttggcggcagctcaagctcaatcgctcagttagtcggctatcgcggcggctggggattagggaatgctttgtttatttcaacagcgcttgcggtcatcgttggtgtatcagtcggaggaagcgcccaagcgattattttgtatgaggctgcgctcggtctcgggatttccgtcgggccgcttgcaggcggagagcttggaagcatttcatggcgcgcaccgtttttcggagtatctgtcctgatgtttattgcgttaatcgcgatttctttcatgcttccgaaattgccgaaaccggcgaaacgcgtcggtgtgtttgatgcgatgaaggcgctaaaatataaaggccttttaacaatggcggtatcggcattcttatacaactttggattttttattttgcttgcttattctccgttcgttctggatttagatgaacacggtcttggatatgtcttcttcggctggggccttctgctggcgattacgtcagtctttacggcgccgctcgtgcacaaagcgctgggcacagtgcgttcgctcgtcgttctttttatcgcctttgcggccattctcgttattatggggatctggacagaccatcagactttgattattacatgtatcgttgtcgccggtgctgtcctcggtatggtgaatacgatcatgacaaccgctgtgatgggttctgcgccggttgaacgttcaatcgcgtcttcagcctacagctcagtccgcttcatcggcggcgcgctcgccccgtggattgcaggaatgctgtcagaacactttactgcaagcacaccatatacagtaggcggaatcgtcgtttttgtcggcatgcttgtccttctcatgggacgtaaacatcttgctggaattaaggcgggacattaataacgaaagacactgccacagatgcagtgtctttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagttgatggttcatgctgtagaggggacgtttgccatggataaggcaaagcctgacgaatatgatcagaagtgtttacaggtgctctatcattacatacacagcgtcatgaaaaacagcttttcgcccgagtggtttaccgcttggacagatgaggaggattttgagctgtctgccaaaagagagctgacacttgatgaattcacatctccattcattttaaaagacagagagcttttgagaatcgttcagaataaatggcagtaaaaaacccgctctttagcaggcgggtttttttataaattaaagcactttcgtcgtccaagactcgcagttccacgtttctgtcgcgatatccatataaaaatctggctcgtgggaaatgagcagaatggagcctttatattctttcagggcgcgcttgagctcttccttggcatcgacatccaagtggtttgtcggctcatcgagcaccagcaggtttgtttctgagttgattagcttgcacaatctgactttcgctttttcgcctccacttaatacggagacgcggctttcgatatgctttgtcgtcagtccgcattttgccaaagcggcacggatttcatactgcgtataagaagggaattcgctccatacttcttcgatgcacgtattgttgtttgtttccttgacctcttgctcgaaatagccggtatagatgtgctcaccgcgttctacagagccttcgagcggctggatttcgccaagcaaacttttcagcaacgtcgtttttccgatcccgtttgcgccgtaaagggcgattttttggccgcgctccatgcggaggttgagcggacgggacagcggggaatcgtaaccgatcacgagatccttcgtttcaaaaatcagcttgcctgacgttctcgccggcttgaaatggaattccggctttggcttttctgccgcaagctcgatcatatccatcttatcgagtttcttttggcgggacatcgccatgtttctcgtgctgacgcgcgctttgttgcgggcgacgaaatccttcagctccgcgacttcctgctgctgctttttgtaggccgcttcaagctgctgttttttcacctcgtagacttccataaactgatggtagtcgccgacataacgtgtcagctcttgattttcaacgtgataaatcaggttgatgacactattcaagaacggaatatcgtgggaaatcaggatgaacgcgttctcgtattcctgcaggtagcgtttcagccattcaatatgctgttcatcaagatagttggtcggctcatcgagaagcagaatttccggcttttcaaggagcagcttagcgagaaggacctttgtgcgctgtccgccgctcaaatcggtgacatcccgctctaaaccgatatcgctcaaaccgagaccgcgggcgatttcttccaccttggaatcaatgacataaaaatcattgtttgtcagcgcgtcttgaatgacgccgacttcttcaagcagcttttcgagctcgtcgggatcagcctcgcccattttgttgtatatctcgttcatttcctcttccatcgcaaataaataatggaatgcgtctttcaggacgtctcgaatggattttcctttttccagcacggtatgctgatccagatagccgacacggacattttttgaccattcgacttttccctcatcaggttcaagctttccggtaataatattcatgaaggttgattttccttcaccgtttgcgccgatcaaaccgacgtgctcgccttttaacaggcggaaggaaacgttattaaaaatggcccggtccccgaagccgtggcttaaatcctttacagataaaatactcatgtttacacctctatcgttatcaaacacgcacaatcggcgtgtaatattcacccttttgattataaaggaggattcggaatgttgaaaggtataggaaagaaaaagaaaaattgcgttccgggcgaggttttgagatactatggaatagatttcaggaattgaggagaacaaaatgacgcaaacttggccatttttacataatgcacaatcatttatacaagagaattggagtgcttccggctttcaaacgccaacccctgttcaagagcaggcagcccagctaatcatggacggaaaggatgtcatcgcggaatcgccgacaggcacaggcaagacgctggcgtatgcgctgccggtcttggagcggatcaaaccagagcaaaagcatccgcaggcggtgattttagcgccttcccgtgagctggtgatgcagatttttcaggtgattcaggattggaaagcgggctcagagctgcgcgcggcttccttaatcggcggggcgaatgtgaagaagcaggtcgaaaagctgaagaaacatccgcatatcatcgtcggcacgccaggcagggtatttgaactgattaaagcaaagaaactcaaaatgcatgaagtgaaaacgattgtacttgatgaagcggatcagcttatcctgccggagcatcgcgagacgatcaaacaaattattaaaacgacattaagagaccgccagcttctatgtttttccgcgacactcaaaaaggaaacagaggatgtgctccgcgaattggcgcaagagcctgaggtgttgaaggtacagcgaagcaaggtggaggcagggaaagtgaaacatcaatacctgatttgcgaccagcgcgacaaagtgaagctgctgcaaaagctgtcaaggcttgaaggcatgcaggcactcgtatttgtgagagacattggcaacctgagtgtatatgcggaaaaactggcatatcaccacgttgaactcggcgttttgcacagtgaagcgaaaaaaatggagagggcaaaaatcattgccgcattcgaagacggagagtttcctcttttattggcgactgacattgccgcacgcggtttagacattgaaaacctgccatacgtgattcatgctgatattcctgatgaagatggctatgtccacagatcaggacgaacaggccgggccggaaaagaaggcaacgtgctgagccttgtgacaaaattggaggaatctaagctgaaaaaaatggcgaagaagcttggtgttgaactgagtgaagctgtgtatgcaggcggaaaactgaagacgaaataaaaagaagggcgaaaagccctttttttgttgtaaaataatagaaaaagtttcgcgcagggggtgggaaggtggtttcaatagacaggtttcaagcagtgaaggagtcagagctgaaaattcttgaacgctggtttgagaatgaggataccagacggagaatggatgggatgctgccattagatgagtggtatgcacgagtaaataaagataaacacgatactgtcatcatggcgtatgatggacagctgccggcagggatggtcgttattgagttcggggagaagcggacatatattggattgatcgtcaatcctttgtaccggcttcaagggtacggaaaacggatattgcaaaagctgatgaccgaacctgattttactagcgtgcgggaatgggtggcatgcattgaagaagacaatcgaatcagtttagcttgctttcaagcagcaggattcactttggaagatacagaacctgatgaagatggttttcttacgctgattcttcgcagctgatctcatcgaaacacaaaaggagggcaaaaagccctcccgttttcatcttcattcagctcggatcactgaccttgatcagctgtttccctttattttctcccttaaataaaccgagaaacgcgtcaggaatgttttcgaagccttctgtgatggtttcctcgtaatggagtttaccagccttcagccattcggccagctgttttgctccctcagaaaaacgatcggagtagtcgctaacgataaacccttgcatcagcgactttgttttaatgagttttgattggacacgagggcccatgtcatctgcttcgctttctgcgttataggaagaaatggcgccgcacaccggaatgcgggcaaattcattgagcagattcatcaccgcgtctgaaatcggtccgccgacattgtcaaaatacacatcgacaccgtcaggacaagcgttttgaagcgctttttggatatcatccgctgttttgtaattgatggcttcgtcaaactgaagctcctgttttaaatagtcgattttttcatcagaacccgcgataccgacaactcgcgcgcctttgattttggcaatttgcccgactgttgaaccgacggctccggcagctccggagacaaccacggtttcgccttccttcgggcgtccgatgtccagcaatccgaagtatgctgttaagccggtcattcccaaaatgccgagataggccgaagcgggagcaaggcttgtatcaatttttcgcaaggcagactcgctcacagcggaaaattcctgccagctgagatttccgatgacgatatcgccttttttcagatgattcccgtctgacacaacttcagcgatgaccccgccagagagtgcttcatccaaggcgaacggttcaacatatgactttgtatcctgcatacgtccgcgcatataagggtcaaccgaaacataaagcgttttgacaagcacttccccttgctggggttcaggaaccggaatggtttcaaagcgaaagtctttatgaacaggaataccttgtggacgtcttgctaattgaatttgctgctgagatgctgtcattttcatcctcctatcacttggttgacaccactgtaacatggacaggagaggaaatacaaaaggtaagctggcatacaaaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctctccttttcatttcgcccgtaatttcgggcacagtcccgtcggcagacacattggcttctggtcgatcgggcttctcatgatgcagcattccaagccgaagacttcacggaaaaatggctgggtgaacacatcttccggtgttccggcgttgtatatttttccgtccagcacactgattagatagtcagcatattgcgcagcttggtttaaatcatggagcaccatgacaacggtgcggccatggtcgcggttcagctttttcagcagttcaagcacttcaatctggtgtgagatgtctaaatacgtggtcggctcatcaagcaaaagcaaatcagtgccttgcgcaagtgccattgaaatccaggctctttgtctttggccgcctgagagggcatccagcgtccgatccttcagttcaatcatgcccgttgcttccagcgcccactctaccatgtcatgatcctcttgggtatgcttggataacagctttttgtgaggatgtctgccaaaatagcataattcctctaccgtcaatccttcaggggcctgaggagattgtggaagaatggccagtttttttgcgacttcttttgatggctggcggtggatgtcttttccttctagtagcactgtaccgcttttcggggccatcagcctggcgagcgatttgaggattgttgatttaccgcagccattagcgccgatgagcgcagtgatttttccttcttctatctttaagtcgactccgtcaataatcactgtactgtcatatgaaagagtgagctggtctgcagccagttttcccatggtatcctctccctactgtttcctcgcttcgaatttcaataaatataagaaataaggcgcgccgatcacggctgtcagtattccggcaggtatttcaaccggaggcatgatgccgcgccctaacgtatctgcaattaataatataatagcaccaatcaatgcggatgcaggcagtaaatatttagctttttctccggtaagccgtctggcgatatgcggagcaagcaagccgataaaaccgattgagccgacgacggctacacagcttcccgccagcgccaccgcggtgaaaatcaggatgaatctcagccggtttgcgttttctccgagaccctgtgcaagctcatccccgagtgacataagatccagcttcggtatgagtatgcagacgatcggaaaaagaatcaaaagccatggcgcaagcagcttgacttcttcccagtttcttccccagaggcttcctgtcagccaaatgagtgcagcattcacgtcgcctggaaactttaccatcatatattgcattccggcgtggcagaccgcgcctaaagcaatgcctgataaagccagtgaagagggctgaatgctcttttttcgggctatcattaataatagtacagcaataatggcggctccggcaaatgcggagaacggaagcacgtataccggcgactcaggaaagatgagaatcacagccatcgccgcaagtccggagccttttgaaatgccgacaacgtccggggaagcgagcggatttcggatcacaccctgtaaaatcgctccggcagcggcaagcccagcaccggccaaaatcgctaatataatgcggggaaggcgatactgctggatgataaattcaaaggaatgatccagtcccagcagattcgtcactaccgcatcaggtgaaatgtataatgcaccgattccaatgctgatgacggacagaacgattaaaatcacggccaatatgagtatcgccagtaaggggcgtttttgttttctggttgttttcttcatttcagatgtcgccctttccttgccaaatataagaaaaacggcgttccgataatcgcggtgacaatgccgaccggtgattcataaggaaatgcaatccatctggccagaacatctgcgtacaccagcaaaatggcaccgaacagtgccgaaaacggaagcacgtattgataatgttctccgatcagcttgcgaacaatatgcgggacgagcagcccgacaaagccaatcggcccggcgacggctacggaagcgccggaaaggattaaaataatcaaactgatcagaatccggatgccgttcatattttgtccaagcccttttgctgtttcgtctccgagaccgagaacagaaacagaaccggaaaatacgagggcaagcccgatgccaatgacagaaaacggagcgatggttatgacatcctgccagttgctgccgtcgattgcgcctgtcatccagtacagaacatcctcacctgactcatttaaaataatgatggcctgtgtcatagaggagaggaacaaatgcacggccattcctgacagcgccagcttaacaggtgtcattccgccggatgaggcaatcatatacacaatcgcgccgcctgctgccgcacccgcaaaagcgaatataacagatgaatagggcgatgccggcagaatgacgagagaagcaacgacaaaaagcgatgcacccgcattcacaccgaaaatttggggtgaagccagaggatttctggtcatagcctgcatcagcgcccctgctacagctaggctggcgccgacaaaaacgccgattaaagtgcggggaaggcgaagagtagagatgatgagctgttcctttgaaccgtcccatacaaaaagatatttcaatgaatctatgatgccgatgtctgaggctcctactgaaagattcagcccaagcccaaatataaaaataatcagtgcaatgatgaacatcatcagtcttgatgatgagcgccgtttggctgaatgatacaacagtctcacttccttactgcgtctggttgcaaaaacgaagaagcaaggatttcccctcgcttctcatttgtcctatttattatacacttttttaagcacatctttggcgcttgtttcactagacttgatgcctctgaatcttgtccaagtgtcacggtccgcatcatagacttgtccatttttcaccgctttgagatttttccagagcgggttcgttttccactcgtctacaatggttttgccttcgttggctgagatgaacaaaatatcaggatcgattttgctcaattgctcgaggctgacctcttgataggcgttatctgacttcacggcgtgtgtaaagccgagcattttaaagatttctccgtcataggatgatgatgtatgaagctggaaggaatccgctcttgcaacgccgagaacgatgttgcggttttcatctttcggaagttcggcttttagatcgttgatgacttttttgtgctcggcaagcttttcttttccttcatcttctttatttaatgctttagcaatggtcgtaaagctgtcaatcgtttcgtcatatgtcgcttcacggctttttaattcaatcgtcggagcgatttgtttcagctgtttataaatgtttttatggcgctcagcgtcagcgatgattaaatcaggcttcaaggaactgataacctcaagattgggttcgctgcgtgtgcctacagatgtgtaatcaatggagctgccgacaagctttttaatcatatcttttttgttgtcatcggctatgcccaccggcgtaatgccgagattgcgaacggcatccaagaatgaaagctcaagcacaaccacccgcttaggtgtgccgcttactgtcgtttttccttcttcgtcatggatcactctggaatccttagactcacttttgccgcttccgttgttattctggcttgatgaacagccagatacaatgaggcaggcgagcaataaaacactcatgatggcaatcaacttgttagaataggtgcgcatgtcattcttccttttttcagatttagtaatgagaatcattatcacatgtaacactataatagcatggcttatcatgtcaatatttttttagtaaagaaagctgcgtttttactgctttctcatgaaagcatcatcagacacaaataagtggtatgcagcgttaccgtgtcttcgagacaaaaacgcatgggcgttggctttagaggtttcaaacatatcagcagtgacataaggaaggagagtgctgagataaccggacaatttcttttctatttcatctgttagtgcaaattcaatgtcgccgatattcatgataatcgagaaaacaaagtcgatatcgatatgaaaatgttcctcggcaaaaaccgcaagctcgtgaattcctggtgaacatccggcacgcttatggaaaatctgtttgactaaatcactcacaatccaagcattgtattgctgttctggtgaaaagtattgcattagacatacctcctgctcgtacggataaaggcagcgtttcatggtcgtgtgctccgtgcagcggcttctctttaattttgatttttctgaaaataggtcccgttcctatcactttaccatggacggaaaacaaatagctactaccattcctcctgtttttctctttaatgttctggaatctgtttcaggtacagacgatcgggtatgaaagaaatatagaaaacatgaaggaggaatatcgacatgaaaccagttgtaaaagagtatacaaatgacgaacagctcatgaaggatgtagaggaattacagaaaatgggtgttgtgaaagaggatgtatacgtcttagctcacgacgatgacagaacggaacgcctggcagacaacacgaatgccaatacgatcggagccaaagaaacaggtttcaagcacgcggtgggaaatatcttcaataaaaaaggagatgaactccgcaataaaattcacgaaatcggtttttctgaagatgaagccgctcaatttgaaaaacgcttagatgaaggaaaagtacttctctttgtgacagataacgaaaaagtgaaagcttgggcataaagcaaggaaaaaaccaaaaggctatgacggccttttggtttttttgcggtctttgcggtggcattttgcagaatgccgcaataggatagcggaacattttcggttctgaatgtccctcaatttgctattatatttttgtgataaattggaataaaatctcacaaaatagaaaatgggggtacatagtggatgaaaaaagtgatgttagctacggctttgtttttaggattgactccagctggcgcgaacgcagctgatttaggccaccagacgttgggatccaatgatggctggggcgcgtactcgaccggcacgacaggcgggtcaaaagcatcgtcctcaaatgtgtataccgtcagcaacagaaaccagcttgtctcggcattagggaaggaaacgaacacaacgccaaaaatcatttatatcaagggaacgattgacatgaacgtagatgacaatctgaagccgcttggtctaaatgactataaagatccggagtatgatttggacaaatatttgaaagcctatgatcctagctcatggggcaaaaaagagccgtcgggaacacaagaagaagcgagagcacgctctcagaaaaaccaaaaagcacgggtcatggtggatatccctgcaaacacgacgatcgtcggttcagggactaacgctaaagtcgtgggaggaaacttccaaatcaagagtgataacgtcattattcgcaacattgaattccaggatgcctatgattattttccgcaatgggatccgactgacggaagctcaggaaactggaactcacaatacgacaacatcacgataaacggcggcacacacatctggattgatcactgtacatttaacgacggttcgcgtccggacagcacatcaccgaaatattatggaagaaaatatcagcaccatgacggccaaacggatgcgtccaacggcgctaactatatcacgatgtcctacaacttttatcacgatcatgataaaagctctattttcggatcaagtgacagcaaaacctccgatgacggcaaattaaaaattacgctccatcataaccgctataaaaatattgtccagcgcgcgccgagagtccgtttcgggcaagtgcacgtatacaacaactattatgaaggaagcacaagctcttcaagttatcctttcagctatgcatggggaatcggaaagtcatctaaaatctatgcccaaaacaatgtcattgacgtaccgggactgtcagctgctaaaacgatcagcgtattcagcgggggaacggctttatatgactccggcacgttgctgaacggcacacagattaacgcatcggctgcaaacgggctgagctcttctgtcggctggacgccgtctctgcatggatcgattgatgcttctgctaatgtgaaatcagatgtcataaatcaagcgggtgcgggtaaattaaattaagaaagtgaaaaacacaaagggtgctaacctttgtgttttttaattaattaaaatgtttattaacttagttaaggagtagaatggaaaaggggatcggaaaacaagtatataggaggagacctatttatggcttcagaaaaagacgcaggaaaacagtcagcagtaaagcttgttccattgcttattactgtcgctgtgggactaatcatctggtttattcccgctccgtccggacttgaacctaaagcttggcatttgtttgcgatttttgtcgcaacaattatcggctttatctccaagcccttgccaatgggtgcaattgcaatttttgcattggcggttactgcactaactggaacactatcaattgaggatacattaagcggattcgggaataagaccatttggcttatcgttatcgcattctttatttcccggggatttatcaaaaccgggctcggtgctagaatttcgtatgtattcgttcagaaattcgggaaaaaaacccttggactttcttattcactgctattcagtgatttaatactttcacctgctattccaagtaatacggcgcgtgcaggaggcattatatttcctattatcagatcattatccgaaacattcggatcaagcccggcaaatggaacagagagaaaaatcggtgcattcttattaaaaaccggttttcaggggaatctgatcacatctgctatgttcctgacagcgatggcggcgaacccgctgattgccaagctggcccatgatgtcgcaggggtggacttaacatggacaagctgggcaattgccgcgattgtaccgggacttgtaagcttaatcatcacgccgcttgtgatttacaagctgtatccgccggaaatcaaagaaacaccggatgcggcgaaaatcgcaacagaaaaactgaaagaaatgggaccgttcaaaaaatcagagctttccatggttatcgtgtttcttttggtgcttgtgctgtggatttttggcggcagcttcaacatcgacgcaaccacaaccgcattgatcggtttgtccgttctcttattatcacaagttctgacttgggatgatatcaagaaagaacagggcgcttgggatacgctcacttggtttgcggcgcttgtcatgctcgccaacttcttgaatgaattaggcatggtgtcttggttcagtaatgccatgaaatcatccgtatcagggttctcttggattgtggcattcatcattttaattgttgtgtattattactctcactatttctttgcaagtgctacagcccacatcagtgcgatgtattcagcatttttggctgtcgtcgtggcagcgggcgcaccgccgcttttagcagcgctgagcctcgcgttcatcagcaacctgttcgggtcaacgactcactacggttctggagcggctccggtcttcttcggagcaggctacatcccacaaggcaaatggtggtccatcggatttattctgtcgattgttcatatcatcgtatggcttgtgatcggcggattatggtggaaagtactaggaatatggtagaaagaaaaaggcagacgcggtctgccttttttttattttcactccttcgcaagaaaacggattttgaaaaatgagaaaattgcctgtgaaaaatggtatgatctaggtagaaaggacggctggtgctgtggtgaaaaagcggttccatttttccctgcaaacaaaaataatggggctgattgcggctctgctggtctttgtcattggtgtgctgaccattacgttagccgttcagcatacacagggagaacggagacaggcagagcagctggcggttcaaacggcgagaaccatttcctatatgccgccggttaaagagctcattgagagaaaaggcggacatgcggctgagacgcaagaggtcattgaacaaatgaaagaacagactggcgcgtttgccatttatgttttggacgaaaaaggagacattcgcagcgcctctggaaaaagcggattaaagaaactggagcgcagcagagaaattttgtttggtggttcgcatgtttctgaaacaaaagcggatggacgaagagtgatcagaggaagcgcgccgatcataaaagaacagaagggatacagccaagtgatcggcagcgtgtctgttgattttctacaaacggagacagagcaaagcatcaaaaagcatttgagaaatttgagtgtgattgctgtgcttgtactgctgctcggatttattggcgccgccgtgctggcgaaaagcatcagaaaggatacgcttgggcttgagccgcatgagatcgcggctctatatcgtgagagaaacgcaatgcttttcgcgattcgagaagggattattgccaccaatcgtgaaggcgtcgtcaccatgatgaacgtatcggcggccgagatgctgaagctgcccgagcctgtgatccatcttcctatagatgacgtcatgccgggagcagggctgatgtctgtgcttgaacaaggagaaatgctgccgaaccaggaggtaagcgtcaacgatcaagtgtttattatcaatacgaaagtgatgaatcaaggcgggcaggtgtatgggattgtcgtcagcttcagggagaaaacagagctgaagaagctgatcgacacattgacagaggttcgcaaatattcagaggatctcagggcgcagactcatgaattttcaaataagctttatgcgattttagggctgcttgagcttggggagtatgatgaagccattgatctgattaaagaggaatatgcgatgcaaaatgaacagcatgatcttttattccataacatccattcgcagcaggtgcaggccattttgttagggaaaataagcaaggcatcggaaaagaaggtcaagctggtgattgatgagaacagctcactcgcgcctcttcctgcgcatatcggcttgtcccatcttattacgattattggcaatttaattgataacgctttcgaagctgtagcggagcaaagcgtgaaggaagttttgttttttatcacggatatgggccatgacattgtcattgaagtatcagacacagggcccggtgtgccgccagagaaaatagaagctgtgtttgagagaggctattcttcaaaggggatgaggagaggctacggtctggccaatgtgaaagactcagtgcgtgaactgggcggctggatcgaactggcgaatcaaaaaactggcggggcggtattcactgtgtttataccgaaggagaaacaaagggggaatccatttgattcacatcgcgattgcggaggatgattttcgagttgcgcaaatccatgagagattgattaaacagcttgatggattcaagattatcggcaaggcggctaacgcaaaagagacattggcgcttttgaaggaacacaaggttgatttgcttctgctggatatttatatgccggacgagcttgggaccgcgttgattcctgatatacgaagccgatttcctgaagtggacattatgattatcacagcggcaacagaaacccggcatttgcaggaagcgctaagagcaggaattgcccactatttgatcaaacccgtaacggctgacaagttcaggcaggtgctgcttcagtataaagaaaaaaggaagctgctcatgtctcagccggaggtcagccaatccatgatcgaccatatttttgggaacagtgtgaagacagctttgccggcagaggatttgccgactggcattaattcgattacactgcgaaaaattaaggaagcgcttcagactgcgtcagaaggattgacagcggaggaacttggggaaaaaatgggggcgtcacgaacaactgcccgccgttatgccgagtatcttgtgtcaaaggaagaagcaagagccgagcttgaatacgggattatcggcaggccggagagaaaatattatttggcggcggattagatatgaaaaaatctataatcctattgattttactattgatctttatgcagggtgatatcaggcaggcggctgcgccgcgcctgccggacgggccgatagaaattgttgtccctgccgaaccttctggcggctgggatgtcacagcgcaggcgatccaatcagttttgaggcagaagcagatcgtgaagggagatgttcatatcgtctataaatccggcggcgggggagagaaaggctggaaatatgtcaacaaaagcagcaaacaaaccatcagcatgacgtccagcctaatattgagcaatgatcttctcgggcaaagtaaattaaaaatgtccgattttacgccgctcgccattctctccaaggaatggcagacggttgcattgccaaaaggatcagcgttaacaaatggcaaggatgtgctgaatgagatcaacatgcatcccggcaaggtgagaatcggctttgccccggggtttggcaatgatgatcagctctcgttcgtcagagcggcagatatgtacggcattgacccgtttgacattcaattctcacagtatgacagcagcgaacagctcattcaggcgctgatcagacatgagatagaagcggcttccatgacactttctgaagcgaaaccatatgaacgaaacggcgatatcacgttagccgctgtaacgtctgataaaagacttcccggttttccaaatgtaccgacgtggaaggagcagggaatcccgtttgttttttctcattggagagggattttgggcccgaaaaatatgtctgaggaagagatttcttactgggatcaagcgctaaagaaggtcacctcctcacctgaatggaagcggaaaataaacgaacaggactgggaaagcttttatttgaacagcagggaaacgaaacggtttttagaagagcaatctgctttttatcaaagcatcatgacaggaaattaagatcccggcatcccgggatttttttcatgccgaaaattgatcaaaaagaacaaaacggttttaaaaaattaaaaatacaaaaaaaccaaattatttacttgcggttggttttcccatacgatggcaaaaaggcaagacaaaaaggggagtaagggagaaaaaaatgtaagcggattcatttaagggggaatggatgtgttagcaatcttaggctttctcatgatgcttgtgtttatggcattgatcatgacaaaacggctttctgttttaacagcattagttttgacgccgattgtgtttgcgcttatcgccggatttggatttactgaagttggggacatgatgatttcggggattcagcaagtcgcgccgactgcggtcatgattatgtttgcgatcttatattttggaattatgattgatacaggcctgtttgatccaatggttggcaaaattttaagcatggtcaaaggagaccctttaaaaattgttgtcgggacagcggttcttacaatgctcgtcgccttggacggagatggctcgacaacgtacatgattacgacaagcgccatgcttccgctctatttgctgctaggcatccggccaattatcctggcgggaatcgcgggagtcggcatgggaatcatgaacacaattccatggggcggtgcgacgccgagggcggcgagtgcgctgggggttgatccagctgagcttacagggccgatgattcctgtcattgcaagcgggatgctttgtatggtggcggttgcgtatgtgcttggaaaagcggaacgaaagcgccttggtgtgattgaactgaaacagccagccaatgccaatgaaccggcggcagcggttgaagatgagtggaagcggccgaagctttggtggttcaatttattgttaacgctttctttaataggatgtttagtatcgggtaaagttagtttaaccgtactgtttgtcattgcgttttgtattgcgctgattgtgaattatcccaatctcgagcatcagagacagcgcatcgcggcgcattccagcaacgtgctggctatcggttcaatgatttttgccgcgggggtgttcacggggattttgacaggcacgaaaatggttgatgaaatggcgatctcgctcgtgtccatgataccggaacaaatgggcggattgatcccagcgattgttgccttaacaagcggtattttcacatttttgatgccgaatgacgcgtatttctacggggtgctgccgattttatcagaaacagctgtcgcatacggtgtggataaagtggaaattgccagagcctctattatcggccagccgattcatatgctgagtccgcttgtgccatccactcatttgcttgtcggactcgtcggagtttctattgatgaccatcaaaaattcgcattgaaatgggcggttctcgcagtgatcgtcatgacggctatcgctctattgatcggtgcgatctctatttccgtatgataattcaggcgtaatgacacacactaacggcatataacattccggaggtgtcattatgagtgatccttatatgccgctgacttcagtcagaagcggaacggggttcgaagcggcaaaaggggtgcacggcctgactgtgcaaattgcgaatgtctattttattcagctgccttctgaacctcactcatttgttttaattgatgccggcatgcctcaatcagccggcatgattgtcaatgaagccaaacaaagattcggtgaagggtttcagctgaaggcgattatcctcacacacgggcactttgaccatattggggcaatcgaagagatccttgagcattgggatgtgcctgtttatgtccattctcgggaaatgccctatgtaacaggtaaagaagattatcctccggctcgtcctgacagcaagagcgggctggtcgccaagctgtcgccgctgtttccgcggcactccatcgatatttcctcacatgtccaggcactgccggaagacggttcagtcccttttcttgacgagtggatgtggattgcgacaccaggacacacgccgggccatatttcgttattccgcgatgacggccgcgtgcttgtggcaggtgatgctgttattacagtggaacaggagaaaatggctgacgtcttgatacaaaaacaggagcttcacggtccgccggcttatttcacgcctgacacagagacggccgctgagtccattctgaagctggccggtcttgaaccggaagcgttattgacagggcacggcataccgatgaccggcaaaaactttcgaagtgacttaactgaattggcaaatcggttatcgtctatttgacacccgcaccacgcgggtgttttttattgttttccaggaagttgcagaaaaatcatttgtcttgccgcttaaaaacgatacaatgaaaagcatgaagtgatgtgaaggggagagtttgttggaagaaaaagaaatactctggaacgaagcgaaagcgtttattgccgcatgctatcaggaattgggaaaggaggaggaagtgaaagaccgtctcgaggacattaaaagtgaaattgacctgaccgggagctatgtacatacgaaggaagagctagagcacggagcgaaaatggcttggagaaacagcaaccgctgcatcggcagattgttctggaattcgctgaatgttattgacagacgagacgtccggacgaaggaggaagtgcgtgacgccctctttcaccatattgaaaccgccaccaataacggcaaaatcagaccgaccattacgattttccctccggaagagaagggtgaaaagcaagtcgagatctggaatcatcagctgatccggtacgctggatatgagtcagacggagaaagaatcggcgacccggcttcctgttccctgacagcagcctgcgaagagctcggctggcgcggagagcgaacggattttgacctgctgccgctcatttttcgcatgaaaggcgacgaacagcctgtctggtatgagctgccgcgttcacttgtgatcgaggttccaatcatacatccggacatcgaggcgtttgctgatttggagctgaagtggtacggcgtgcctatcatctctgatatgaagcttgaggtcgggggcattcattataatgccgcgccatttaacggctggtatatgggcacggagatcggagcgagaaacctcgcagatgaaaagcggtacgacaagctgaaaaaagtagcgtccgtgatcggcatcgccgctgattacaatacggatttatggaaggatcaagcgctagttgaattgaataaagctgtgctgcactcgtataaaaagcagggtgtcagcatcgttgaccatcatacagcggcaagccagtttaaacggtttgaagaacaggaggaagaagcgggcagaaagctgacgggagactggacgtggctgattccgccaatttcacccgctgccactcatatcttccaccgctcctatgataactcaatcgttaagccgaactatttttatcaagataagccttatgagtaaacaatagaaaatcgatgatggccttcaaggctgcgggattcagtcacagagatgtcggtaacctttgagaaagggcttccgttctttacagcctcaacaaacgattgcagggcgttttccggaccctctgccaaaatctcgacacgcccgtcatcacggtttttgacccagccggccagttttcgcttatcagcttccatttgaacaaaatagcgaaagcccacaccttgaacccggccgtttacaatgattcggtattgaagcatgtaaaaaccaccttttctttttatgataatcaatcattttacaacctgtaaaggggatgtgtttgtatgaaaccagagcgctattcagttctttctcttaatctgggaaaaccgcagacgcttgaatatgacggaaagaaaatcgaaaccggcatcatgaagcggccggctgaatcagccgtcatgctgtatcgggagaattttgaaggagacggacaggcggacctcgtcaaccacggcggacctgataaggctgtctgtgtctacccggcggagcattatccgttttgggaagagttcctctcaagaccgctgtcaaatgccgcatttggagaaaatctgacggtcgcgggcctgactgaggagaatgtttgcatcggggatgtgttcaggcttgatgaagctgttgttcaggtcagccagccgcgccagccgtgtgtaaagctggcgaaaaagtttggtgtaaaagaaatggtgctgaaggtccagcaaaccggctatacagggttttattttcgcgtgctggaggagggcagggtgtctcccggcgcgaaccttgaattgctgtccagaggagagaagggcatctcagtccagttcgccaaccgcatcaactaccatgatgcaaaaaatctcaccgccattgaacggattttaagtgaggctgcactatcggaaagctggagagcgtcctttatgaaaaagaaggacaggctgctgccggttgaatagaaaaaagccgcgcatatcaacgtgcgcggctttgccatatttaagattgttttttctttgtttcaagcaggttggcaagaaaataggttttatagctttgaagctttcttccctcatggtgcgtgatcccctgcttttttagttctgccacataccagcctttactgccgtaatgcatgtcagaaaactcctttccctatctgatttcgaaacgattggcattgtaacatctataaaaagatgctgaaaagagatgcggggaaaactgagcctttcgcactagatgtacgaatgttcttctgtatgtatatgcggagcaaaagccgaatatgatttaatggccggttagtttgatcatgacaacgccaaatgtcataatggcgaaaacaatgccgatatatgtgagcatcccgttttttttcttaacgccgtaaacggtcataatgatgccttcaatgaaaaaaatgatgccgaaaataataaaccacatgcagataaaggctcctttcacagacataatagtagtgtagcatatctgaaagagccgggctgtgacaatatcaagaaagccgggcgcatatcgcccggctcatgttttattgtttatcaaccaatttgaccagaagctgtgccaaatgttctttctcatcttcgtctgcaacgctccaaagctcttgcagcagcatttcttcaccgttttgcggctcttcatgctttgcgaggtagtctcccaggatcgcagcgctttttacaagcttgccgtcatccaatcccagctttttgcctcggttgacttgttttttcaagtagcctttaaattcctcaaagtcttttaaaatgtcttcttttattgtgccatgcatcgcgttcatttcgttttcaatttggattttttcttgatctctgttcattgcaagacctcctcgtgcagaataatgatgttttacctgctattggaggaggttaaacctgccggaagcccggaatgtgttttacagtttcgtcaggataatcggttcatcttttgtgatgacgatcgtgtgttcaacttgggcaaccatgcttttatccggcgtcttgaacgtccagccgtctccagcttcaacaatcgtttctgctttcgttgaaataaacggttcaagcgcgatgactgtgccatttttgaacagtgcgttatcaaacggatcataatagttcatgatgtggttcggcgcttcatgcaggcttcggccgattccgtggccggtcagggttttgatgacggtaaagccttgagagcgtgcttcatgataaacggctcttccgatctggttttggcgcttgcccgcttttgcctgctgaagccccttttgaaatgcgttttccgcgcattggcaaagcttatgaaggcgttcttctccttcaccgagcacaaatgagatgcctgtgtcggaatagaagccgccaaattcagcggagatgtcgatgttgacaaggtcccctgcttttaaaattttggatgtgcttggtatcccgtgagccacttcatcatttacgctgatgcatgtcacacctggaaaatcatattccttctcaggagctgaaacggcgccgtgctcatcaagcacagcttttccgataaggtcaaggtcttttgtgctcatgccgggctctgccttccgcttcatttcttcacgcgcaagcgcgacgattcttccgatttttttcagaccttctaattcttgatcgtttgttacaatcatctgtcattcccgctttctttttaaataatctagattaagcttaccacaactgtcttaaaaataggaaacacacgggcctgggaaaaaagaaatacccccgggaaaattggtatagatcactagatatcttatatggtatatttgaaaaaaaaagggtatgagggggatgggtatgctttcatttttacaaaaactcgggaagtcatttatgctcccgattgcggttctgcctgcggttggaattatccttgcgcttggcagagaggatgtatttaatatcccgtttgtttatcaggcggggacggcggtttttgatcatctgccgcttatttttgcgatcggaattgccatcggcatttcaaaagacagcaatggggccgcgggtttatcaggggcgatatcgtatctgatgcttgacgcggcaacaaagacaattgataaaacaaataacatggcggtgtttgggggaattattgccggtttaattgccggttacacctataaccgcttcaaggataccaagctgcctgaatatctcgggttcttcagtggcagacggcttgtgccgattataacagccattattacgatcattttagcgggcatattcggagtcgtctggccgccgattcaatcgtgtataaactcgtttggagagtggatgctcgggctcggcggcatcggggcaggcatattcggcctattcaacaggctgttaattccgcttggccttcaccatgtgctgaacaatattttctggttccaatttggagaatataacggagtgacaggggatctggcgcgctttttcgcgaaagatccgacagcgggcacatatatgaccggattcttcccaatcatgatgttcggtcttccggcggcgtgtctggctatggttgtgactgcgaagccgtctaaacggaaagcgacggctggaatgatgattggatttgctttaacagcgtttatcacagggattacggagccgattgagtttgcatttatgtttttatctccgcttttatacgctgttcacgcggtcttaaccgggttatctttatttatcgtcaactggctcggcatccgttcaggcttttctttttcagctggagctatcgattatgtgctcagctatggaatcgcggaaaaaccgctgcttctgcttttggtaggtatatgctatgcggcagtatactttatcgtgttttatgtactgattaaggctttgaatttaaaaacgcctggacgggaagacgatgatgtggatgaagtgctggatgaaaatactgtccaggatgtaaatgaaaacatcatgctgaaagggctcggcggaaaagaaaaccttcaaaccattgatcattgcgccacaaggctgcgactgactgtgaaggataccgctttggtggatgaagcgctgctaaagaaagcaggcgcaaaaggggttgtcaaatcgggcgggcaatcggttcaagtcattattggcccgaatgtggaatttgcagctgaggaattgagggctgctgtcaaataaaaaagcggagagggcaacctctccgctttttcttatttatcttcgttatcctttgacgtttcggaagaatcttcgtcatgttttgtgtaatcataatcggaaggattcaccttcttaaaacctttcggctcgtagaaccgcagcaggtctccgtttatgattttatcggacatttcaagttccttcttgacgagcgagtcttctgacttgtcgacttcggattcatcgagttcttttccggttttcgtgtcgtaatacttaccggatattttcgtgtacttcggtgaaataaagtctccgttgcggaacggaatcacttcacggtgttctttcgataaaatatcagaaccggacatcagatagtccttcgtatccactccgagcagatgcagaatggtaggagccacatcaacgtctccggcatatttatgaactttctcgcccttcacgccggcagcgtggataaagagcggcacccgttgaagctgggcgttgtcgtaatcagtgatttcatccttgccaagtactttcgccatcgctttattgtggttttcagagatgccgtagtggtctccgtacatcacaataatcgatttatcatataacccgtcttttttcaggtcattgaagaattgttcaatggactgatcaaggtaatgggctgactggaagtagttatcgacgacagagtcaccaaagtctccagccgggaagtctgtatctccctcatccattccgaatgggaagtggttggacagggtaatgaacttcgtatagaacggctgcggcaggctttccagcagcggcattgattctttgaagaacggtttgtctttcatgccgtagtttttcgtgttttcttcgttcatgtcatagtaggcagaatcaaagaatttatcaatgccttccgctttgtacatttcgttacggttccagaacgtctgcgtgttcccgtggaaagtagcagatgtgtaattcttagacttcagaatcgccggaacggattgcagcgtgttttgcgctttgtttacgaaaactgaaccttgagccagcgggtacagagagttttccatcataaattcagcatcagatgttttgccttgtcccgtttggtggaaaaagttatcaaagtagaacgtttcgttatcatgtgccagtttatttaagaacggtgtcacttctttgccgtcaattttatagtcgatgataaatgactgcaaagattcaagtgaaacgtaaatgacgttttttccttccgctttgccgaaatacacgttattcggcacatcgtaattggctttcatgtagttttctacttccgtcacgtcgctggaatcggcaagcgcgcgctggctgttggacttgatattctgtacagcgtcataaatcgtgaaattgtatgttcccaagtatttcacaagatagttccggtcgaatgatcttgtcagcaattcaggacggtctgattccgcaactgccaggttgatcaagaacacaagaattgaagacgcaaaaataattcggaacgattttttgcttgacgtttcggcaggcttgtttactttgatcgccaagatgatcaggatgatcgtatcgataaagtaaaaggcgtcagtcggtctcatcagcgaaaatgcgctgtcaccgagttggccgccgtttgttttagcctgcataatgaccggaattgtaataaaatcattgaaaaatctgtagtacacaatgttggcgtacagtaaaaaagacattaaaaaatgaatcactataatggctgtctgctgtaattttttcttgaacaagagtccaaagccaagaaagaacaagcttgagctaagaggattcacaaaaagcaatattttttgtatcgtgttgtctattcctaagttgaagttcaggacataactgacatacgttttgatccataacaggacgaccgcgattaagaagaaggccagtcctctttcttttataaatgttttcattgttacactccttttttccgatccagttcgagcgaaacgatagaaaaaacgaacgtatccaatataacacgaatcagcagattagaaaagtgaaaatcgtatgatggagaaagtggcgaaaaacgccgtcgaatcaacgtttcgctttgatattaccaaatgtaaaacaaggtatctttctagaaatagaggaataaaatggtacattgggaattgtatgataaaatataaggtatagataaaaagaggtgaaatgatgaatttttcccatattgtgtctgaagataaaattaagcgcgccatcaaagacggggactttcaaaacctcccgggaatggggaagccgctgccgaaggatgacgcggcacacttgccggaatcgctgcgcatgggctatcgtattttgaaaaacgcgggaatggcagaggacgagggcgctctcaaaaaagagcttatgaccatcgaccatttaatcgaaaagtgctatgacgaaaaagaacgcgagcaattaatcaggaaaaaatctgaaaagcaattgctgcttgataagcttgtcgacaaaaaaggcatgttttcaaagccagcatccgctttttataagaataaagtatatgaccggcttggacgaaacagaccttcttccagctgatttgtcttgtctgcaggatggcgattgataaaagccatcctttttatgttccaagttctatgtcaaaaggtttatgtttttccatctatgggaaatgccccataaacgaaaaaagggtgatgggatggaacgactattagtatggatagagcatatatctgattggctgtgggggccgccgctaatcattctgctgacggggacggggttgtatttcactattttgctgaaaggttttcaatttcgctatcctttatacattttcaaacagacaatcggcagtgtaggaaaaaagccgaagggagagggcacagtcacaccgcttcaggcattgacctcagccctcagttcaacgatcggtgcagcgaacattgtcggtgtgcccgccgctattatgtttggaggaccgggagcggttttttggatgtggcttattgccttatttgccatggcgattaagttttctgaaagtgttcttgctgttcattacagagaaaaaaatgagcagggtgaatacgtcgggggaccgatgtattacataacaaaagggctgcgcatgaaatggctcggcgtattcttctctgttgcgctgattgtggagctgatccccagcattatggttcagggaaattcggtttcagtctcgcttgctgagacgttttctttcaataaaatatacgcaggaatcggaattgcgtttttgattgggttagtggtgataggaggggtaaagcggatcggaaaagtaacagagtttgtcgtgcctcttatggcaggggcatacgcgggtgccggtctcctaattgttctcatgaatctatcatcagtgccggcgtttttctctctcgttttttcaaatgcgtttacctcttcttcagcagttggagggttcgcaggtgctgcgttggcggaaaccgttcgctggggatttgcccgcgggctttattctaatgaagccggaatgggaacagccccgattgcacatgcggcagcaatgactgatcatcctgtgcggcaagggttttggtctgtgatcggcattgtcattgacaccttgatcatctgcacgaccaccgcttttgtcgttcttgcatctggtgtctggacagggaagaacgcctcaattgatccggcagcactgacgacggctgcatttcagcattatttcggttctggcggagggtacttcgtttcggtttccctagtcttctttgtcgtatcaaccattatggttgtcattttttacggcgtaaagcaagctgaatttctgttcgggcggctggcaggacacgtgattaaattcgtttatttagcggctattatcataggtgccgcaggcggagcaaaagccatttggggctttttggacttagcattggcttttattctcgtcccaaatgtgattgcgctgttgttattgagcagaaaggtaaaagcgctgtacaccgaattctttacatctgaacagtactacctgaaagatataagaaaaacaaaacagaatcctgtttatcaaacaaaagaagctaaaaactcctagtgctttgctttggcgccgaacaacgctttgctttttatgatcaaataaatgagtaaaggcagcaaaatagaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacatggctttcgggtcgttttttgagtataagagcgataggctgtaccacgatannnnnnnnnnnnnnnnncttcaccataatgacgggaatccaaaaggccgcgatgatcaggtctgagcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagatacaatcatcaccatggggcagacacaatttccgcatcagtactgtcccaataacaagagcgccgaggatgccgaccgtctgaccaacggttttcggcaggcgcactccctcttcacggagagcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgaggctttcagtgaagccctctctcgatcctttgatggtcgattctgttattaacttttcaaagtttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacaataaatccgcacagcccgtttccaaagtcaaattgtctaaatacgatgtttgagcaaccttctgtaagctgggtcagattatcgaggttttccttcaaattgggagagatcggtctgtcctgattgtcttcaagctctttgatgagctgaagcgctttgtcgcgtttattcatagaggctcaccctgctttttaatgtcatattcaataagtgcttgtgacttttagggtaaccttgtctgtttcatataatccagactaggatgaaagcgctataaaaaagtgttgactacctgtatatacaggaatacaatatgattataagttgtatatacaagttataaaaacggatacggaggggttggcatgggggaactgaacaaatcggcacgtcagattgtcgaagcagtcggcggtgcagaaaatattgcagcggcaactcattgtgttacacgtttgcgttttgctttaatagatgaaagcaaggttgaccaagagatgcttgatcaaattgatgtggtaaagggatcattctcgacaaacggacagtttcaggtcgtaatcggccagggaactgtcaacaaagtatatgctgaagtggtcaaggaaacgggaattggcgagtcaacaaaggatgaagtgaagaaggcctcagaaaaaaatatgaatcctttgcagcgtgctgtgaaaacgcttgcagatatttttattccaatattgcctgcgattgtcacggcgggtcttttaatggggatcaataacattttaacggcggaaggcattttcttcagcacaaaatcgattgtgcaggtttatccgcagtgggcggatcttgctaatatgattaacctgattgcaggcacggcctttacgtttttgcctgcgttaatcggatggtctgccgtcaagcggttcggcggcaatccgcttctcggcattgtgctcggagttatgctcgtgcatcctgatttgctgaatgcgtggggatatggagcggcagaacaaagcggagagatcccggtatggaatctattcggcctagaggtgcagaaagtcggctatcagggccaggtgctcccaattttgcttgcttcttatatgctggcgaagattgaggtatttttaacaaaacgcacacctgagggcatacagctgctcgttgtcgcaccaattacgcttctcttaacgggatttgcctcttttatcattatcggcccgattacatttgcgatcggtaatgtactgacttcagggctgatctcggtgttcggttcttttgccgcactgggcggtctgttatatggcggtttctactcagcgctcgtgattaccggtatgcatcacacgtttcttgcagtcgacctgcagctcatcggatcaaagctcggcggcacctttttatggccgatgctggcgctttctaatatcgcacaaggttcggcagctctggccatgatgtttatcgtgaaggatgagaaacaaaaaggcctctccctcacatcagggatttctgcttatcttggcattacagagcctgccatctttggggtgaatctgcgatacagattcccgtttatcattgcaatggtcagctctggcctggccggaatgtatatttcttctcaaggtgtgctggcaagctccgtcggtgtcggcggcgtaccggggattttctcaatcatgagccagtactggggcgcgtttgcaatcgggatggctattgtattgatcgtgccgtttgccggaacatacgcgtatgcgagattcaaacataaataacaaatggggagcgggacgtgttgaacgttcccttttcccgttttcaatttaaatatggtggtggaaacagatgaaaacagaacaaacgccatggtggaaaaaagctgtggtttatcaaatttatccgaagagctttaacgatacgacgggaaacggtgtcggcgatttgaacggcattattgaaaagttggattacttaaaaacacttcaagtggatgtgctatggctgacgccgatttatgattctcctcagcatgataatgggtatgatatccgtgactattactcgatttatcctgaatatggtacgatggaggactttgagcgcctgctgtccgaagcgcataaaagagacttgaaagtcgtcatggatcttgtcgtcaatcatacgtcaacagagcacaaatggtttcaagaggctatttcgtcaaaagacagcccgtatcgtgatttttatatatggaaagatccgcaggaaaacggttctcttccgacgaactgggaatcgaaattcgggggatcggcatgggaacttgatgaagcgtcgggccaatactatttgcatctgtttgacgtgacacaggctgatttgaattgggaaaatgaagaggtcagaaagcatgtctatgacatgatgcatttttggtttgaaaagggaatagacggcttcaggcttgatgtcatcaacctgatttctaaagatcagcgctttccgaatgcggaggatggcggcgacggccgctctttttacactgatgggccgcgggtgcacgaatttctgcatgaaatgaacgaaaaggtgttttcgcattacgacagcatgacggtcggtgagatgtcttcaacaaccgtagaccactgcatccggtatacgaatcctgacaataaagaacttgatatgacattcagcttccatcatctcaaggttgactatcctaacggcgaaaaatgggccttggcaccgtttgactttttgaagctgaaggagatcctatccgactggcaaacggggatgcacgcaggagagggatggaacgctctgttctggtgcaatcatgatcagccgcgcatagtatcaagatatggagatgatggcgcatatagggtgaaatcggcgaaaatgcttgctacggccattcatatgatgcagggcacgccttatatttatcagggcgaggagctgggaatgacgaatccgaagtttactgacatcagttcctatcgggatgtcgaatcgctgaacatgtatcacgcctttaaggaaaaaggaatggctgatcaagagatcacagccattttgcaggcgaaatcccgtgacaattccagaacccctgttcagtgggatgctacggagaatggcggttttacaacgggcacaccatggataccggttgcaggaaattaccgggaaatcaatgctgaagcggcgctgagggatcagaattcggtgttttaccattatcaaaaattgattcgaattcgcaaaatgtatgacattgtgacagagggaacgtatgagttaatcgcaaaggatgacccgaacatttttgcgtatctcagacacggcagcaatgaaaagctgctcgtgatcaataatttttacgggacagaggcggcctttacactgccggactctttagcgcctgacgaatggaaggcagaggtgctgttgacgaacgatgaagcaagggaagggcttcagaacatgacgcttcgcccgtatgagtccattgtttatcgtttaacgaaaccgtgttaaactaagctgggtggtccataatgaaggtgaataaattcatcacaatttataaagacatcgcacagcaaattgaaggcggccgatggaaagcggaggagattcttccgtctgaacatgagttgaccgcacagtacggtacatcaagagaaacggtccgaaaggcgcttcatatgctcgcgcaaaacggttatatccagaaaatcaggggaaaaggctccgtcgtgctcaatcgtgaaaaaatgcagtttcccgtttcgggccttgtcagcttcaaggagctcgcgcaaacgcttggcaaagaaacgaaaacaactgtacacaaattcgggctggagcctccgtcagagctgatccaaaaacagctccgggccaatctggatgacgacatctgggaagtcatcaggtctagaaagattgacggggaacatgtgattttggacaaggattactttttcagaaagcatgtccctcacctgacgaaagaaatttgtgaaaactccatatatgaatatatagaaggagagctcggtctttcgatcagttacgcccaaaaagaaattgtcgccgagccgtgtacggacgaggacagagagctgctcgatttacgcggctatgaccatatggtcgtggtgagaaactacgtctttttggaggataccagtttgtttcaatatacggaaagcagacaccgtctcgacaaattccgatttgttgattttgcgcggcgggggaaatgagagaggcgcctgcctgcggcagcgcgcttttttgtttggtatcaaaattgatactatccaacaaaaatgtgcgtacttttactttttatcataatggctacaatagagatgagagtaatctaaaggagaggtgttttacatggcagatctaaagacacaaattctggatgcatacaatttcaggcatgcgactaaggaatttgacccgaataaaaaagtgtcagacagcgattttgaatttattttagaaacaggaagactgtctccgagctcactcggccttgagccttggaaatttgtcgtcgtccaaaatccggaattccgcgagaagcttcgtgaatacacatggggcgcgcaaaagcagctgccgaccgcaagccatttcgtcctgattcttgcgcgtacagcgaaggatatcaaatataatgcggactacatcaaacgtcatttaaaagaagtaaaacaaatgcctcaagacgtgtacgaaggctatttaagcaaaacagaagaattccagaaaaacgatttgcatttgcttgaaagtgacagaacattgtttgactgggcatcaaaacaaacctatatcgcgcttggcaacatgatgactgccgctgcgcaaatcggtgttgattcctgcccgatcgaaggcttccagtacgatcacattcaccgtattcttgaagaagaaggccttctggaaaacggaagctttgatatttctgtgatggtggcattcggctaccgtgtgagagaccctcgtccgaaaacaagatctgctgttgaagatgttgtgaaatgggtgtaaataaagaaagctgctcgcttagcgagcagctcttttttatgcttgatttgctttactctgttttcttctttgatacaagtacaatgccgttccgagtgcactgatcagaaatccagccaaaaggatggagtacatggatgtggctgtgtccggaagcaagccgccagccgggccgtcagtgcctgatccgcttgatccgtttcctccagagccgtttgtcggatcagtgccgggaggtgtatgatttcctccgtttccgtcagtcggctgttttccgcccggtttgtcagagcctcctccattgctgccgtcatcaccgcctgtcggctgatcggacggaaatgccggcggtttgttgttggaaccggaatttaaaatcgtgtattcgctgaagtggtttgtgtaacctgtaacgatatcatcttccaccgatccgttttctgtctttgtgaaagctttctttttccgatcgacatggtaaatggccggattatgagcttcttcaatgtcaaacatgcgaagcgaaagctgaacgggctctttgaatgattttatttcttttcctttttgcctcactgtaaagtcatacacatctgcaagtgagacatcaaattctcccgttgacgtaattccgattgaggtatccgtggttttgaggttcgccattggcagtttcatgctgtaccagtagttgaacaccgtcaatgaagaatctgattttctttctttcaatagtttgatctggtcttttttcactttaagattgataggcttctcttgagagccttcatgtgttccataatagacaaaaggcgtgttggcatttttagcgtaaatcgcaaatttgtcttcatcaagtgtccagctgccgtctttctgcttagtcggcaggaatacttccttgatgcgtccttcaattttaggagagaccttgtttcctagttttttcagctgttcggtgaaaatttcataataaacgtagccaaggtcttcaccatgggacgcttcagtaaagacagaatatccgtctcctccggcaccgacaaaattattcgttgccacgcggtaggtatcatccgtatgtagatcaactttgtctccgttaggcaattcaattttcacttctaacacacggtgtccaggttcgttgtttaatgtaaaggtatattcaattccggccacctgagggaaagcgccgcctccgttttccacattgcttaagccttgttcaagggcttctttaatttgttttccggttaagtcggccacgtaaagcgtattgccgaacggcatcacgttcagcacctcgccgagtgtaatatcgcctttgtcaatgccggctctgatgccgccgccatttgttatcgctattctggcaccggctgcttctttcgcttttgccagcataccgtccgcaatgaagtttccgagatttgtttccttcgtgcgcacatgctcacgctggccgtcaagcgccacatccgtatagccgactttttcatttttcacgtcttctaattcacttttgaactgatcgagctcttgtttggcttctgcattttcttctgtatgctcatcaattggcagcacgctcagatttgatttgtctgtttgcacaacgccattttcatcaaacgcgacatcaacgcgccccaagaattgaccgtattcttttgcctgcgccacgatcgtcggctcttcattgtttacgacttccattttatctacgagggtgtgggtgtgtccgccgatgatcaggtcaatgccttttacttttttcgccagctcaaggtcacggttatgaccgatatgggtcaaagcgataattttatttactttttcatcttcctgtatcgttttgactgtgttttgtgcggtttcaaacgcatcatgaaagacgatgcttttgcccgggctcgatgtggtggctgtatcttccgttgtcagtccgaatacggcgactttctcaccgtcaacgtctaacagaatgtaagggtggatgccgggcgccttcttttcacccgccctaaaggtttgcggctttttgacataggatgacagcttaggctcatttgacacatccacgtttgcgctgacgaccggaaattcaggcgcttcaaagcggtagcggttggccggatcgacggttgtgctgtttccgctgagaaaatcagaaagcactgccgggcctttatcaaattcatggtttccgaaggtcatggcatcatagcccatcatgttcatcattttcagatcagctaaaccgttccattttgtaaaatacaggtcgccggaaaatacatctcccgcatcaaggagaatgttgtgatttgtttcgctgcgtacttcgttgattttcgtcattcgtcttgctgcatcatcgagatgtgcgtgcgtatcattggtgtgcatgacggtcaggtcccacagtccgtctttaggaggatctggatttgaatcatcatcgaattgcagcttatacacaccatagccttcattcgcagacttgcctacataagcgacgtcgtctgctttatcggcaaatggcttggccaaaagcgaggattcaaacgtcagattcgtgccggaaacaggcgcgattgaccagttgttgtctgcctttggattgactgttttttgttcaataatgtaatccatcagcacctgcctgttttcaaccgcagagccgtggacaattttatcactcgtcagatgagggaacccgccgcctcctgacgcacgatagttattggtgaccacgagaaattcctggcttgggctgatcggcttgccttcataggaaaggttgatgatccgggatgaatccgcattgatcacttttccgttctcattgtatttagccggttttgtcacatcgacctgatatgtgacaccgtcaatcacgtcaaaattataggagcggaaattctcgttcagcaaggcctgatcgccgcctttggctggatcaatttgattgaattggcctgctgacatctccagccagtccttgacttcgctgcctgtcagtttgacgatttgaacagtattatcgtaaagatacaagtcaccgacatttttaatcgcaagatctccggctggaatgtttgtatagtaattggctccgtttctgccgcctgctttaaatggtgctccagcggataaaatcggcaggtccttgtactcggtatccttcatttctttttcggcataccatttttgcgcgtcagtcacgatctgaatggaaggatcatctttgacctgtgcaaagaagctgttaatatctgcttcggttttgccgactggctttcggacatactccagtgtgttttggtgtgtttgctgaatggtgtttgtaacggtctcgtttcttgatgtgacgttgccagcaatagattcaatacttcctttggaatctgctaccttccatgagccgtccgccttttcaagcttgaggtcaatcacgcctaaatatttaccccagctgcttggcatgacgacaggaatgccgttaattgttcccttttccacgtcgaattgagcaacacccgcatactccgcggaaggaaagagtccgtgctgatggcccgagataatcgcgtcaatgcctttcgttttagtggcaaggtcaaacacggcgttttctgcacctgatgattgtgactgcttttcaatgccggtgtgggcgagggcaataatgacatctgcgccttccgccttcattttcgggatcgtttcattggcggactctacgatatcctgcacctgaacctgcccctcgagattctttttgtcccatgtcatgatttgcggcgggacaaagcctatgtaaccgacttttactttctgctcattaccgttttcatcaatgaggtttttttcattaatcacatacggcgtataacggtttttaccgctagttgttttgacgttggcatttacaatcgggaaatcggctcctttgattgtgccgtcgagaaagtcgagcccgtagttgaattcatgattgccaagcgttccggcgtcgtatttcagcgcattcatgacgctgataatcggatgggttttcgtgccggagataatgtcgtctttttgatatttcaccgcgtattcacccagcggattcccttgaatcaagtcgccgttatccacaagcagggtgttagggttttgctcgcggtgcttttggatcaattgcgctgttctcgccagaccgaaatccgccgtttctttgtcgctgtagtaatcgtaatccatcatgttggcatgaatatcagtcgtagccaaaatactcagatgcacctgaggagccgcactttcttctgcatgaatgggtggtgttgggaggattaggctaagtatcataattgggggcaaaagaatacggagaatgttttcgacgtgtgttcgtcttttctgtattctcaccagttctccacctttcaacgaaatttgtgttacagctcctattgtaagaatattttgtaactatttgtaggtgtttctttatgattattgtaaaagggagaaaaatgagtattatgtatcagtatcaagcgacaaatactgggtatttatgcttaacgtttgtcacaatcgcggaatgtttattttagtgtggctggggtagagtgttttatgtagacatataaagcgggaggttatgaatcatggggaaaaaaattgcagttgttttaacagattattttgaggacagcgagtacactgagcctgcgaaagcctttaaagaagcgggacatgaactgactgtcatcgaaaaagaaaaaggaaaaacagtaaaaggcaagcagggaaaagcggaagtgacggttgacgcgtccattgacgacgtaaacccttcagactttgatgcgcttttgattcccggaggattttcaccagaccagcttcgcgctgacgatcgtttcgtccaatttacaaaagcgtttatgactgacaaaaaaccggtattcgccatttgccacggcccgcagcttttaatcaatgcgaaagcgctcgacggccgaaaagcgacgggctatacgtccattcgtgttgacatggaaaacgccggtgccgacgttgtggacaaggaagtggttgtttgccaggatcaattggtcactagccgcacaccggaagatataccggcatttaaccgcgagtcattggcattgcttgagaaataagaaaaaacggacgctcttgggcgtccgtttttttgttgcttaggcttgagcacctgtcagtttcttgtacctgtaatacaagaaagcagctgcagccgttccgataaccgcaatggcgaagtcgaatatgaaaatatgagcgatgccccccgcttttgcgataagccctgttgcaatcggcagcagaatcgatgcaagacttgaagcggtcgctacaattccggtaacggttccttttcgcttccagaaaagctctgtcattaacgtaatggtaatttgaaacacacccgcagttgaaaagcctaagaaaaaggcagtgatgtccagcacaactgggatgtgaacggtcagcatgactgcgagcgtacataaagtaataataggatataagagcgttatgaagacaggtttgacccatctgttcagcaaaacggctaataataaaacagatgccagagatcctatactataatagctcagcagttgtacagatgctgattcagctaaaccggctgctttttgcgcgtagctcgggagccagatttgagaaaccgtaaataaagccgtggatgtaaaaccgatgataatcagtgcggtgccttctttctgaaaaacgggttcagacaagaaaacgggagattcctgttggccgctattagttggtttcttatgttttttaggaaacgaaagcgttgataaataaataatattcaggagatagaccgctgccggcagataaaaagcaaatccgtaaaacatgctgtggtctgctaaaaatgtgatcaaaagcggcaaaagtgcggccccgacagacataaaggctttgaccaagacattcgccgaaccggaagcagacggaaagagctcggttagggccggatatgttccggcatccatcgctgaatttgcgactccggctaataaggcgaacacaaacgccagctcatagctcggtgataaaggaataccgactaaaaagacggccataattcccgcagaagcgacaacaagcggctttctgccgattttatctgatagaacgccggaaatgccgtatgtcagcagtttgccaaacccgatagcggcaatgacataactgatgccggtcggatcggtattccactgttttgttaatgaagacatattggatgcgagaatgatgttgaccatccccagaaagaagtagttgatatacattccggatgctgttttgatagatgtcgtttgcatgcttgtactccttcaaatcttattcgaacactttgctgttttggtttggggaaatgataaaaaagactcgccgagtttccggccagtctccattatttacgaagcgaggctaattcttgagcaatcgcctgcatttcacttgggctgaatgattcttttttcatcaccatgctgtgaaggtacgtgaggtcttcaatcttctcatcactgaaatcctccgctttgattacgccgacgttcagcatgttcagcttttgggaaatctcttcaatcatttgagttaatgtttctgtatttgggctggacaaatggttccatcctttctatgcgcaatataggtatgttttattctaacagaatttcatcagaaaaaaaccctattctaaaagcaggctgtttattccaaaaaagtgaagacatcagttgaaaaggaaatgaacatcctactaagatagtcatgaaggtttctttttagagaaataggggcaaagaatagggaggttggacaacatgataagcgtgttatttgtttgtttaggaaacatttgccggtctccgatggcggaagcgatttttcgggaccttgcagccaaaaaaggattagaggagaaaatcaaggcggactcagcgggaatcggcggctggcacatcggcaatccgccgcatgagggaacgcaggagatattgcgcagagaaggaatcagctttgatggcatgctggcgcgtcaagtcagcgaacaggatctggccgattttgattacatcattgcaatggatgcagaaaatatcggaagtctcagaagcatggcgggatttaaaaacacctcacatatcaaaaggcttttggactatgttgaagattcagatcttgccgacgttcccgatccttactacacagggaattttgaagaagtctgccaattaatcaaatcgggctgtgagcatctgcttgcgtctattcaaaaagaaaaacaattgtgagtgaaaggagaatttgcatgaacaacgaacgtttaatgctgaaagggatatttctcggagctgcggcaggcgcggcgttatcactgctccataagccgacaagacaggcgtgcggcatgagatggctgacatgcaagcataaactttcactgtataaaagcaatccggagctgttaaaaaacactgttatcacaaaagtggatgaggccaaaaagctcgcccaaacgctttcaaaggaagtcgactttgtgaaccagcaggtgaaagagctgaagaaaacaacgccgcaagtgatggaactcgtgcaagaaacgaaagagcatttttcaaaaaaatgatcaaacatgcgaggtgagacgacatgagttttttgaaagagcttttcagcagatacacccttcatgaaggacaaagtaaatcagcggagctggcgtatttttttctattgtcactgtttccttttttgatttttatgctgacgctcaccgcgtatcttccgctttctaccgatgatgttttaggagtcatagaacaatatgctcccgccagtgcgatgtctctcgttgaatccattacccatcaaaccttaaataatcgaaatggcggtttgctgtcattcgggattatcgccgcattatggtctgcgtctaatggaatgaacgcgatcgtccggtcgctaaaccacgcgtatgatgtggaagaaaaccgctcttttatcattgttcgtctaacctcgatttttttgacgattgccatggtatttacgattttagtggctttgcttctgccggtatttggccgggagattggaaggctcgcttctgactttgtcggcgcgtcggatctgtttttatccgtctgggccgccattcgctggggtgtcagcccgcttgtgcttttgattgttttttccgcgctgtatgtgattgcgccgaacaaaaaactgtctctccggtttgtcatgccgggtgcggtctttgcgactatcggctggatcattgtcagcacattgttttcattttacgtcagcacgtttgcgaactatagcgccacttacgggagcatcgggggaatcatcgttctgatgatttggttttacttgagcggcattttaattatcctaggcggagaaatcaacgctcttttacataaacgtaaaaagcttcctgatgaaaatccctaccattagcgcaccctataaacgaacttcggttcaaaaagaagtcggggggatatcgtgatgaccaagcatacgaaaaaaggcggaagccataacaaacaaaactcgaaaagcaaatcgagccataaaacaagcggaagcgccaacggacaaaacggctaccattagcataaaagcctcctgacatgatgtcgggaggctttttgattaagaagatgaagaataggtttcagccggtgaccagcttttcggtttgcccagcacaagggccagccacacagcgctaagcgtgagagtaatgaagtagaacaagtttgcgctttcaaatgtctgcatataccagccgccggcaaccggaccgaggatgctgccgagactgaatgtaatgccgcaaagcaggtttcccgccggcaggagatgaggcggaagaagatctgtcatatagctgatgccaagtgtaaaggttgatccgactgccattcccgcaataaaaaagcagccgccgatcacgtaaggcgaaggaaatacaccggcgatgaaaaagcaaagagccccagtcagtaaaatcaccagcagcacattccgcctgccgtatttatcgctgaggatgccgagcggaaactgaaaaataatgcttccaatcgcaaatgcgggaaggatgatcgctactgcgtctactgatatccccaaacggagcgcgtacaccggaaagcttccgttcagcgccgtttccaaaaagccatagccaaatgtaggcataaaggcaacccacccaaacagcatggcctgataaaatcgcctgaaactattgtctgatttggtttcatgaggactggtttccgggtatgcattttgtagaaagaaaacaaaaagccacgcaaacagactgatgcagccggacacgataaaaggaagcgacggactcagcttgacaagcggcaccatgaacgggcctgcggcaaagccaaggccaaaggaaagcccgtaaatagacaggtttcttccgcgattttgttttgatgacatggaggtcacccacgtttgcgtagaaaagtgaagcatgtggtcgccgattccaatgaacaggcgaagcaggaaccagacccaaactgactgaagccaaataaatccgaataagcttaaaatgacaatgcttccgcccatgacgatcagcggcttgaacccgagctttctgagcggcgcttccataaacggcgaagccaaaagcacaccgatatacagcccggtcgcgtgcaggccgttgatagcagcggattctccatttgtttcaaaaatgattgaaatgacaggcagcagcatgccttgtgaaaacccggaaatggatacgagcaagacaaggataaagaaatgaaatcgtgacatcgtgtcagttctccttatgtggaatctatgttgatcgtacaatgttttccaaaagcaggcaacctgaaaaaagcctatatcacgctatacatttgccctcgtgtaatcatgaaggtttttgtgaagaataaaaataaaacaagtcataaaaaaggagctatttcaccatgaatcgtatcttttttattttagtggcggccggtgttccgctttctgtgattggcagtttgatgcattggccttccgcggttctatttgccgtttattgcgtgacgattatcgctcttgcaagctatatggggagggcgacagaatcactgtccatcattgcaggaccgcgtatcggcggtttgttgaatgcaaccttcgggaatgcggtggagctgattatttccctttttgcattaaaagaaggcctgacaggaatcgttcttgcctctttaaccggttcagtgctggggaacctgctgctggtagcgggcctatcgttttttgtcggcggtttaaaatataagcggcaggaatttaatatccatgatgcccgccataactccgggcttctgatttttgccatcattgtcgcctttgtgattccggaggtattctctgttggtatgggaaacgccagcaagctcaatttaagcatcggcatcagcatcattatgattctgttgtatgtggcggcgctgtactttaaacttgtcacgcatcggggcgtttatcagccgaataatgccgctcagactgaagaagaggaagagccggaatggtcagggaaggttgcgacgattgtcttgtttgcggcaacgattgtggtggcatacatatccgaaaacctggtccatacctttcactcggtggctgaacagttcgggtggagcgagctgtttatcggggtcatcatcgtggcgattgtaggaaatgcggcggagcacgcgtcagcgattattatggccttcaaaaataaaatggacattgcggttgaaattgcagtcggctctacgctgcagatcgctatgtttgtcgcaccggttctcgtcatctgttctatcttttttccgacaagcatgccgcttgtatttacattgcctgagctcgtcgcgatggtatcagcggttctcttgatgatcgcgatttcgaatgacggggattccaactggtttgaaggtgcgacactgcttgctgcatatgtcattatggcgatcggctttttccttctttaacctgaaaaaatgatggataacaacaaagcgggatgaaaagactaagggaaaatgccatagaaagagtgatatgatgaaaaagctatttcattccacacttatcgtgttgttattctttagttttttcggcgttcagcccatccacgcgaaaaagcagtttaaggttcctaattctgtcgcaagcatttcaaaggaaaacacgtatccgaatgcttcacaggatcagccaatgcttcagccgagcaagctggcaaaggaattgctcgatcattctgaggtgaagattgaaaatccgcatctcatcaaaatgctgaatgaatccaacatatccggcacaccgcttgcagtagggtaccgggcgacaatatttctcgggaaatgggcgctcggctatgaatcaaatgaaacagtcgcaaactgggaatataaaaaaatcaatacaaaccgtgcggataaccgcggcgggaaagaaacggctgaaatgcattatgcccaggaacagcagtacagagtgaagggcggcctgacagctaaagttccaaatgctgaagatgtcaaaagcatgatgatgcaaaaagcaatgaagaaaacggacctcccgcttgcatttgagacggtcattggggctggcacaaaacgggatcagatttataaagtcgctcctaaaaaaatcggttatttacatgcatatgcaccggctgtgaatgaaaaaggaaaagtgacttacggagaagtgtacttagtgctgaaaggaaataaacgaaaactcgtcgtgaaaaatgtcacgtcacagggcatcggcgcgtggattccggttcaagatcatgtcacatttggctttcagctttcctcactgccaagataaataaaaaactgattccaactcggaatcagtttttttgtttattgggttctctcgattcggaccgcttcctcaagcatttgcacattgttttggtagagcaggcgaacgagaacccgtctgactgcaaggctggcactgaaataatcatcatctttcaccatgcctttaaccgtaaattcgacgccgcgattgattttattcaatgcggtgatgccgtggatttgaaatggttctgtcggattgccgaatacatcccgcttcaatgaatcacgaagctcttcattcagcatgtcacatgcctcttccaacacgctgtacacgcggtccggatcttctttaaagctgataagaaaggattcggtaatccgcataaaatcaatattatagttctctatttgtctgacctcgccgttgctgatggtgagcagcttcccgctccattctcggatttgcagcgagcggaggccgatttcctccactgtcccgttgaacaagttgttgacggtgacataatcgcctttgtgcagctggcgttcatatattaagaacacaccagccagcacatctttgatcagcgattgggcgccaaaaccgatcacgatacctgctacgcccgccccggccaatatcttgccgaaatcatgcacaaataaagaaataacgtaaaaaataaaaccaattgtcgccgtatactgggtgacagaacggacaaggctttcaatcgttttttcctttttttcttcaataaaatccgtccgtttaaaaaatagctgtaccagccggttgatgataaagacaccgatccaaaggataacggcaacgaggagaatatcgacgattttagtttgaaaaatctccgtaagtgtttctttcatccgcatctaactcctggcttgacgttttgtgaagtctgtatcctgataataactgtttttgacaagaacattcggtccgaggcaccggacattcgggcagtggcaacttagttctttcgcaagcttggtctctctccacttttcataggcggaagggaggctgtccgtctgaatgttgccaagcggcggggtatcaccgaaatcggtcacgataatgtttccgtcgaaaatgttcacattcaggcgggaccggccgtcagggtcatttcgcactgtgacgtttttcgccgcgcgaagccggcgaagcagcttttggtcgtcttcgtccggactgcaggcataaaacggcagcgttccgaacagcatccacgtattttcatcacgaatatccagcaagcggtgaatggcctgtctcatctctttcaggctgagggattcaagagcgcttgcgaaatcgcttggatacattgggtggacctcgtgacgctgacatttcatatcttctgtgatttggcggtgaatatgctcaatatgcggaagagttcgtttgttcagcatcgtttccgcagataccattactccggcatccacgagcgtgcggctgttttcgatcattttttcaaaatagcgcgcgcgctgttcgaaggtcggttttctgtccatcatggcaaagccgatttcagcaaaatcttcaactgtaccccagttatgagaaatatgtagcacatcgagatacggaatgatccattcgtaccgctcgatgtcgagggtcagatttgaattaatttgtgtccgcacaccccgttcatgggcatatttcaataaaggaacaacatattcttttactgatttcaacgaaagcatcggctctccgcctgtgatgctgatggatctgaggcgcgggatttcctccagccgttttaacagaagatctattggcagagcattcgggtctttaggctgcaatgtatagcctacagcacaatgctcgcatctcatattgcacagtgtcgtcgttgtgaattcaacgtttgtcagctgcatgtctccgtattggtcaacatccatataggcttcccaagggtcaaactcgggcgtaatcggacgcagcttcgtgttttgtgtcatgactatctaactcctttataaatgggcatactaacgctgccaacagttaattttagacctgatttgccaagatcgcaagtagcgcggcgattgaaaaaccgcaaaaaatgagctaccattataaaaaatgaatggaggaacagaatggggaacgccgtaaacaataaagatcagcagattgattatttaaagaacagacttgacatgtttatgaacgtcatcgattcattagaccctgaagcaaccgacgttgaagatatagacaggctcatcagcatgcttgatgacctggaagccaaatacgaacgttttaaaaaagattgggaataaaaccgcgcgcccgccgcggtttttttattggcataaagcaacagtataaaacaaagtctctatctgtaaaataagaaaaaatgcagaaggagcgctggccatgaagtggatgtgttcaatatgctgcgccgccgtattgcttgccggaggtgcagcacaggcggaagcggtgccgaatgagccgattaattggggctttaaacgaagtgtcaatcatcagccgccagatgccgggaagcagctgaacagtttaattgaaaaatatgacgcgttttatttagggaatacaaaggaaaaaacgatttacttaacgtttgataacggatatgaaaatggctatacgccaaaagtgcttgatgtcttaaaaaaacatcgcgtaacaggaacgttttttgtcaccgggcatttcgtaaaggaccagcctcagctgatcaaacgaatgtcagatgagggccatattatcggcaaccattcctttcatcatccggatttaacgacaaaaacagctgatcagattcaggatgaactagattcagtcaacgaagaggtttataaaattacgggaaagcaggacaatctgtacttgcgtccgccgcgtggcgtgttcagtgagtacgtactgaaagaaacgaaacgcctcggctatcaaaccgttttctggtcggtcgcttttgttgattggaaaatcaacaaccaaaaggggaagaaatatgcctacgatcatatgattaagcaggcgcacccgggagccatttacctgctgcacaccgtatcaagggacaatgctgaagcgctggatgacgcgattacagatctgaaaaaacagggctacacttttaaaagcattgatgatctgatgtttgagaaagaaatgaagatgccgtccttgtaatgagaagagcctctcctgaaatggagaggcttttctttattttatacatttaatcagtgcggcccagtccagatctccgaagccctgttcaatcccgctttcaaaatggctcttggccagctcggcaagaggaagatttgcagaaacccgttttgcggcggcgagtgccaggttggtatccttcagccctaaagacattttgaagccggccggctcaaatttctgctcggccataatggttccgtaattttgatagactggagaaccaaagagcgcgctggcgatttctaaaaattgtttttgttctaagccgtatttctccatcattaagaaggattcagataacgcctccagcatagacacgagtaagaaattgatgctgattttcgctgcatttgctatcttgctttcttcgccgacgtcaaatacctgctggctgaggctgtcgagcagaggcttggcggtttgcttcgcttccgccggtcctgctgttatgatgcgaagcgcggctttggctgcggcatccggtctgccaaggacgggagcggcgagaaaggattgtcctttctctgcatgagccgctgcgagcttttctgagaactcaacactgattgtgctcatcgagatgtgaatgccgttctctgctaatccttcaagcagcccgtcttctccgaatgtcacggtgctgacagaatcatcatctgcaagcattgtgatgacaatatcagcggactttgccgccagccgcggcgtatcagctgcctgtgcgcctgctgtgacaaggtcttctgtcttttgtttcgtccggttatagacagtcaattcgtagcctgcttgaagaacatttcgggcaatgggctgtcccatattgccgagtccgatgacagcaattttcaatctgatcactccctgaatattttttccattataaacaatataaacagaatatgcatagcaatcggcttacaacaaaaaagaacagcttcccgctgccctcatttaaaaatattgaaccatcctttatgtacaaaccaaatcagcatcccgattacaagcgcagccatcaggccaagtacagcaaaatatccgtatttccaatgcagctccggcatgaagtcgaaattcataccgtatacaccggcaataaaggtgagcgggatgaaaatggttgatacgatcgtcagtgtcatcataatcgcattcatccggtttgagtttagcgtcacgtagctgtcacgcaaatcggacgtcatgtcccggttggattccacaatttcagacaactttaacaaatgatcgtatatgtcactgaagtaggctttcgtttcccgctgctctttcacatggtcaaggcttaaaatccgatagagcaaatcacgcatcgggataatcgtccgtctcaaatgcaataggtctgttctgagatcaaacacctcattcatcagcgttccatacgttttgtggggacggctttcttcaatttcattcagccggtcttcgattttatacacgagaggaaaatattcatcaacaagctgatccatgatcatataagaaatatgcccgggcccttttttcaatatgtccggtgaagcatacaaacgctcccggactttagcgataccgggcgtttcgtgtaaatgaaaggtgacgacaaatttttcgccttgaaagatatcgacttcctccgtctcaagtgtttccttattcagcgcatgaatcacgtaaaaacgatagccgtcataatggtcaagcttcggccgctgcatatgctggaaacaatcctcaatggcaagcgggtgaaaatgaaaaaaatctctcaataacgccgtttccgtatcctccgggccgtaaaaatcaacccagtaccatgcaatatcaggctgttccactcgttcgattggtatatttttcagcagctgatgctctgttgtgattgcggtaatgttgatcataaacaaccctccacctgccattatatcatgcggtctttatgagaaaagtatacggtactctctgcctaattcaagcggcatgttatactgaacaaaaacggaaaaagggtggatctcatgtggaaggaaaaagtatctgtcacgcctccgtatcattttgaccgcgtgctggacaggctgtctttagaccccctcaatgctgttgatcgagaggcgagggaagtccgtgtgccaatcagaaatcaagcgggggacgtatgtattgtaaaggtacaggcgttaggccatgcgggcgagcctgagttcctcgtcagcggggaaacggatcagggagaaatgatgaaggaaatcaagcggatttttcaatgggaaaatcatttgcagcacgttctggatcatttttcaaaaacgagcctgtccgccatttttgaagagcatgcagggactccgcttgttctggactacagcgtgtacaactgcattatgaaatgcattatccaccagcagctcaatctttccttcgcttacacgctaacagaacggtttgttcatgcgtttggtgagcagaaggatggcgtgtggtgctacccaaagccggaaacgattgcggaactcgattatcaggatctgcttgatctgcaattcagcatgagaaaagcggaatacaccattgatacatcaaggatgatcgcagaaggcacactcagcttgtcagagctgccgcatatggcggatgaagacattatgaagaaactgatcaaaatcaggggtatcggcccgtggaccgtgcaaaatatcctcatgttcggacttggccgtcccaatttattcccgcttgccgatatcggcctccagaatgccatcaaacgccattttcagctggacgataagccggcaaaggatgtcatgctggcgatgagcaaggagtgggagccttatttaagctatgcgtctttgtatttgtggaggagtatagaataattcgtctgacaatgaaggaaatcctgcaaacgtgttatactagaaagatgtgaaaaaaccatttcactttctgccatccgcagaaagcttcatatagaaacggagagaacaacgtgaaccaacaaaagaaacaggcgcccgtcgaactgaaggtcggacaaacctttccgctgacgattaagcgtctcggcattaacggagaaggtgtcggctattttaagaaaaaagtcgtcttcgtgcccggcgcgcttcctggcgaagaagttgttgtgcaggccacaaaggtccagccgaagttttcggagggccgcattaagaaaatccgcaaggcatctgagcaccgggtggcaccgccttgccctgtttatgaacaatgcggcggatgtcagcttcagcaccttgcatacagccagcagcttcgggaaaaacgcgatatcgtcattcagtctcttgaacgccatacgaagtttaaagttgaaaacatggaaatcaaagaaacgattggcatggacaacccgtggaattaccgcaataaaagccaattccagatcgggcgctcgcaaagcggcagcatcatcgccggcttatacggccttgattctcatgacatcgtgccgattaaagactgtatcgttcagcatccggcaacgaacaaaacaacaggcatcgtccgccgcattttagaggacttcaatgtgtctgtttataatgaaagaaaacgaaaaggtgacgttcgcacgatcgtgacgagagtcggctttgaaacaggcgaagtgcaggtcgtgcttgtaaccgcaaaagaaacgcttccgcacaaggaagaaatcgtcaaagcgattcaaaagcgattgccagaggtcaaatccattattcagaatgtaaacggggcgaaaacttcagtgattttcggtgagaaaacaaaaccgctcgccggaaaaacagtgattcaagaagtgctcggcgacgtatcttttgaattgagcgcccgcgctttcttccagctcaatccggaacagaccgtcaagctgtatgatgaagtgaaaaaagcggcgcagctgaccggaaaagaaaaagtcgttgatgcgtattgcggcgtcggcactatcggcatgtgggtggcggacggagcgaaggaagtccgcggcatggacgtcatcaaggaatcaattgacgatgctaagaaaaacgccaaaaaacacggcatggcaaatgccacatacgtaacaggaacagccgagcactggctcccgaaatggacgaaagaaggcttccgcccggacgtcgtcattgtagacccgccaagaacgggctgtgacagcacgttcctggacacgatcaaaaaagtcaaaccgaaacgctttgtctacgtttcctgcaatccatccacgcttgcgaaggatttgcagacgctgtcgaaggactatcgcgtggactatattcagcctgtcgatatgtttccgcagacggcgcatgttgaagcagtggcgagacttgtattgaaatcgtctaactaaaataaacacaatacctaataagacctggatttcggtaaaataaacaattccgatttccgggtctttttcatgtgcagcccttgtcctgactgtctgttctcaattttatcttccttctcattctcggagatctttattttaactggcgaaaagagttgaaaaaacgtgttgaaaagcgggtgaaaaaaagcgttatttaaccgggaaaatttccttccagtatgattaaaatacatgagaagaatgatgtgaaatcatagatatttttttcataatttgtaaaattatatattgacttgcagttattacgtgtgaaatattgatgataggaatataaggaaaggtatggcgtatatcatttcaagagtcattcgatgtaaaaagttgaaacattgtaataaacgaaagaggtgaaaatgatggccaaccccattttaaaatgaataacgtatgagcactacaacaattaaataatagtgccgacgataacaactattacagtaatacctacaatggttatatccttgcgacaatcatgcttcataataatttagattgacacttggctaaaaagtattgcagagaaggaaatggataactaaatggataaagtatataaaagaagttggtttcaaacatttttggcatttttagtatctcagctttattttaattttgtagaattaacgggatggggtcctaagtatagagaaatgaatggattcccagcaaacatagttgaactagatttctttcaaacatatctttcattctatgataatccatggtttaatattattactgttttcttgggagttttcactattatacaaataattacaggggtaacaaaggatattcgaaattaaagcaataacttctgatgccttatttaatgatgaaagaaaatgtacactttcttaattatcttatgagtgaagactgcgacacttagtcagcagtctattttatggttctggatcaggattaccgaattataaccctatacaaatatatagtaggttgccacttgctgcgttggttattttctaaatcatgagcaaatcccaaatgattcagattgaagttcttgaattcttttaaataagggtttattttctcttctcatcctctttactccatgtgattcacaagtggtagcagcttaagtagaggttttttcattctcttgagtattcagttataccacccccaactcaatttgcttaatcgaagtttatctcttgaaattagtttttccgcaaatatgatattgagatacggatatggtgtagcgttaaatatcttatcttcaataacagggcaattattttgcgttggtaatatggagaactcatatgatattctatttaggttggaatcctttttatccaaaagttcaaaagtaaggccactaagaaagacgaaggtcagcgcgagttaaccacaatataaaaaatagggtagataatcatcccacgtgaaatgttcaaaatttactatagattgataagaaatgctttcgcatgcgataagtgtaaaaagaagcatggtcagtttttaatttgggataaaggttcagccgtatcccataatgaaaggatttgaatgtattatgacagataatttctggcgtgaattgccacggccattttttgtactggcaccaatggaagatgtgacagatgttgttttccggcatgtagtaagtgaagcaggcagaccggatgtattttttacagagttcacaaactcagagagctattgccacccggatgggaaggatagtgtgcgtggccgtttgacgtttacagaggatgaacagccaatggtagcccacatatggggggataagcctgaaaacttccgtaaaatgagtattggcatggcagagttaggatttaaaggcttagatatcaatatgggctgccctgtacctaatgtggcagggaatggaaagggaagcggccttatttgccgtcctgcagttgcggcagaattaatacaagctgcaaaagcagggggattgcctgtaagcgtgaagacaagacttggatacacggatgtggatgaatggcgcgagtggctgacacacattttgaaacaggatattgcgaatctttctattcatctgcgtacaagggcagaaatgagcaaagtagatgcgcattgggagctcatcccggagattaagaaacttcgtgatgaggtggcaccagatacactgttaacaataaacggggatatccctgaccgccaaactggcttaaaacttgctgaacaatacggtgttgatggaattatgattgggcgcggtatttttacaaatccatttgcctttgaaaaggagccgaaagagcatagcagcaaggaattgcttgatctcttaaggctgcatctggatcttcatgagaaatattcagcattagaagcccgtccgtacaagcctcttcctcgctttttcaaaatttatctccgcgggttccgaggggcaagtgaattaagaaatcaatgcatgaacacaaagtcaacagatgaagtgcgtgcattgctcgacgactttgagagaaagtatcttgatggggtagaataacagcagtgcttgattcaaaaaaggctaacaaaataaagggatttttacaccattcttgactaaaataaacctggattttcggtaaatccgggtcttttttgtacgcagcttttactcagcctgtcttttctctaatttattgtaagaaaataatggtatatttagtggagatatcttataaagggggagaggaaaatgaaacggctatgcatcatcccctgcggcaagaaaaaaatctgggacgtccagcctgatgccgggccggtaagagcagaggacgcttatctcagcccgtttcatcaggcgtgcgaacggtatgcgaaagcatttttcgatgagtgggtgattttgtctgcgaagcacgggttcctccgccctgatgatctcgtttcgggaaattacgatgtcacttttggcaccggtcatccggaaatcatgacagcggacgagctgagccgccaatttcacgaaaaaggcttttctgatatcgaagagctagtcatgcttggcggaaaaaaatatcgaagcgttctaaacgccgtcatcggagaacaccagcatatcagctggccgctatcatcatacaaaggcattggctacatgctccaagcgttgaaccgggctgttgaagaaaagcatgaactgtagcacgcacatatgaagaaaagagtgggatcatgaaaaaacttgtgtttggcttgcttgccattgcattattcggatgcggactatatatctatcatgtatggttcggtgatccattttcgaaaaatgctgcagaacagaagctagtctcttatgtgaaacaaacctatcctaagaaagaaatcaagatcacgaatggggtatataacgctaaaacctctgaatatgtattcgaagcaacctcccaatctcatcgctacccaatgtgtacgaagggatttctgcatcctaaagtaacgtgcgatggaattgaagaagcgtataccgaatcagtatcaaaacatgtaaatgaagaagcaacgaaggcaatcgaagcagatctgaaaaaagcggttcctcgacttataaaagctgatgctgctttgagtattgaaaacggacagttcacgtcagatacaaaatggaacaaacagctggctgaaaaagcgcctatgagcatgacgattcagttagacgccagcgggttatcaaaaacagatgccgcaaagatggcggaaacggtcagaaaaacgcttaatgaaaagggatatacatactcaaacggcacgatagactgtatgcagaaggacggggacggcggtatcggatatgtcaaatattcaattgattttctttcaaaagcagctattcagtcaaacgatgcagaggaactaggaagttaaaaagatttccaaggaaataaatacgtcgatcattgtcaaaggccgggtgatatccggtctttttttgcatgctgtaaaacgagacaaatgaatcagtttgagacaaaacgagacacacgtctcaaactgtctccaaagtgaagacgagaagactggttttacgggctcaaaagactggcacacttcttgcatttataatggtgaaccctaaatagaaggaggcgcacaaaatggaattgttaaaacgagaaggcttatcattaactgaggaaaaagcgctgtggatgtaccaaaagatgctggagatcaggggctttgaagacaaagtgcatgaactgttcgcccagggagtgcttcccggattcgttcatttatatgccggtgaggaagctgtggctgtaggggtgtgcgctcatttacatgatggcgacagcattacaagcacccacaggggacatggacattgtatcgccaaaggctgtgatttggacggcatgatggcggaaattttcgggaaagcgaccggattgtgcaaaggcaagggcggttctatgcacattgcggatcttgataaaggcatgttaggcgcaaatggaatcgtcgggggcggctttacgctcgcatgcggatcagcgctcacggctaaatataaacagactaaaaatgtaagcgtttgctttttcggggacggggcaaataaccaaggcaccttccacgaagggctgaatttagcggctgtatggaaccttcctgtcgtatttgttgctgaaaacaacggctatggcgaagccaccccatttgagtacgcatcagcctgtgattcaatcgccgatcgggcggctgcttataacatgccgggggttacagttgacggcaaagatattttagcagtttaccaggcagccgaggaagcgatagaaagagcaagaaacggcggaggcccatctttgattgaatgtatgacctacagaaactacggccatttcgaaggagatgcccaaacctataaaacgaaggatgaaagagttgagcaccttgaagaaaaggatgccattcaaggttttaaaaactaccttttaaaagaaacagatgctaataagctgtcagacattgaacagcgtgtcagcgaatcgattgaaaaagccgtctcgttcagcgaagacagcccatatccaaaagattcggagctgctgacagatgtgtacgtgtcatatgaaaaaggaggaatgtaagagatggcgagagtcataagcatgtcagacgcgatcaatgaagcaatgaagcttgcgatgagaagagacgaagatgtgcttttgatcggtgaggatgtcgccgggggagcggcggtcgatcatttgcaggatgatgaagcatggggcggtgtattaggggtcacgaagggactcgtacaggaattcgggcgcacaagagtgctggacacaccgatttctgaagcgggttacatgggtgcggctatggctgcggcttcaaccgggctgagaccgattgccgagctgatgtttaacgattttatcggcacgtgctttgaccaggtgatcaaccaaggggcgaaattccgttatatgttcggcggaaaagcgcaagtgccgattaccgtccgcaccacatacggagcagggttccgggccgctgcccagcattcacaagcgctgtatggccttttcacgagcattcctggactgaagacagttgttccatccaatccgtatgatgccaaaggtcttctgctttcagcaatagaagataatgatccggtgttcttctttgaagacaaaacgtcctacaacatgaagggcgaggtgccggaagattattatacaattcccctcggaaaggcggacatcaaacgtgaaggcaaggatgtcacgctatttgcagtcggcaagcaggtcaataccgcgcttgaagcggctgcacagctttcagagaggggcatcgaagccgaggtgcttgatccccgcagtctgtctcctctggatgaggatgcgattttcacatcgttagaaaaaacaaaccggctgatcatcattgatgaagccaatccgcgatgcagcatagccacggatattgctgcgcttgttgctgacaagggctttgatttgcttgatgcgccgattaaacggattacagcgccgcatacaccggttccgttttcaccagtgcttgaagatcaatatttgccgacaccagataaaattgtcagggtcacgcttgaattgcttggcgagccggcaatgaattaaaggggggacacaaatggcggtaaaagtagtgatgccaaaattgggaatggccatgaaacaaggggaagtatcgatatggaataaaaaagtaggcgacccggttgaaaagggagaaagcattgccagcattcaatcggagaaaattgaaatggagatcgaagcgcctgaaaaaggaacgctgatcgatatcaaagtgaaagagggagaagaggttccgcccggcacagcaatctgctatatcggggacgccaatgagtcggtgcaggaagaggcgagcgcgcctgttgctgaagacagtgtgccgcaagccgttcagcccgtcaaacaagaaaacaaacccgcagcctccaaaaaagatcgaatgaaaatatctccagtcgccaggaaaatagcagaaaaagcaggattagacctaaaacagctgaaaggaactggaccaggcggacgaatcgtgaaggatgacgtgacaaaggcccttgctgaacagaaaaaagatcaggcaaagcctgtgtcggagcagaatgcgcaggaaatcccggtgacaggcatgagaaaggtcatcgctgtccgaatgcaggaaagcttagcaaacagcgcgcagctgacgatcacgatgaaagctgatatcaccaagcttgccactcttcaaaaacagctttcaccaactgcggaagagagatacggcacaaaactgacgatcactcattttgtctcaagagccgccgttctcgctctgcaagctcaccctgtgctgaacagcttttatcaaaatgagcgcatcatcacacatcctcatgtgcaccttggtatggctgtagccttggaaaatggcttagtggtgcctgtgatccgccatgctgaaaagctatcgctgattgaactggctcaatctatctcagaaaatgccaaaaaagcacgcgagggacgtgcgggaagcgaagaactgcaaggctctaccttctccattacaaaccttggcgcgtttggagttgagcatttcacaccaatactaaatccgccggaaacaggcattctcggcatcggagcaagctatgacacgccggtgtatcaaggggaggaaatcgtcagaagcacgatcctgccgctcagcctgacatttgatcacagagcgtgtgacggcgcccctgccgctgcattcctgaaggcgatgaaaacatatttggaagaacccgcagcattaattttataggaaaagcaggtgaaaacgacatgacattagccattatcggcggcggacctgcaggctatgcggctgcggtttccgcggcacagcagggcagaaacgtgctgcttattgacaaaggcaagcttggagggacctgcctgaatgaaggctgcatcccgacaaagtctttgttagaaagcgcaaacgttcttgataaaatcaagcatgccgacagctttggaatcgaacttccggcaggtgcgatatcagtcgattggagtaaaatgcaaagccggaaacaacaggttgtcagtcagcttgtccaaggcgttcagtacctaatgaagaaaaatcaaatacaggttgtaaagggaacagcctcctttctttctgaaagaaagctcttgatcgaaggagaaaaaggaaaagaaatcagagaggcggaccaagtattgattgcctccggatcagagccaatcgagctgcctttcgccccgtttgacggcgaatggatcctcgacagcaaagacgcgctttctctttccgagattccgtcttcactagtcattgtcggcggcggtgtcatcgggtgtgagtatgcagggctgttcgccagattgggatcgaaggtgaccatcattgaaacagcggaccagctgatcccggctgaagacgaagatattgcccgtctttttcaggagaaacttgaggaagacggtgtcgaagtgcatacctcatccagattagagcgggtggatcggacggccaaaacggcaatatggaaaagcggtcagcgagagtttaaaacgaaggccgattatgtgctggtggctatcggcagaaaaccccgtcttgacggattacagcttgaacaggccgaagttgatttttctccaaagggcattccggtgaatgggcacatgcaaacgaacgtgcctcatatttacgcgtgcggagatgctatagggggcattcagctggcgcatgccgcttttcatgagggcatcatcgctgcttctcatgcttccggaagggatgtcaaaatcaatgagaaacatgtgccgcgctgcatctatacgtccccggaaatcgcgtgtatcggaatgacagaacgtcaggcaagaagcatatacggcgatgtgaaaattggcgaatttcctttttccgcaaacggcaaggcactcattaaacagcaagcggaaggaaaggtcaaattcgtggctgaaccggaattcggcgaaatcgtaggtgtctcgatgattggcccggacgtaaccgagctcatcggccaagcggcagcgatcatgaatggtgagatgacggcagatatggcggagcattttatcgccgcgcatccgactttatcggaaacattgcatgaggcgctgttaagcacgatcgggcttgcagtacatgcataataaaggaaaaagcaggtgcatggatataaggcgcctgcttttttattgttgaaagcgctttatttttcccctacaatagatgaaaacggcgtgtaagggaggagcgatcaaggaaatgaattcggtcccaaacgatttgcaaacctggaaacgttttgtgaaagacggtgtgcttgacgaagcccgattaagaaaacggattgccgagtcatggcatcgctgcaaaaaagctgaggtcaatccttatttagaaaaaggcccgaaggttttacagcaaacggagctggatcagcagtcaaaaaaacattcattcttcttgacgaccgcaaagccttacctcgaaaaactgctgcctgccataaaagaaatggaaatgatggcgctgctaattgattcagacggtgttgttctggcattggacggccattcccgcgcgctctatgaagccaaacgcatcaactttgtcgaaggggcatgctggacggaaacggctgtcggaacaaatgcgattggcacggcgctccacattagcgagccggttgcgatacaaggatcagagcattactccattgcttcccatctttggaactgttcagccgctccgattcaccatgaggatggcagccttgcgggtgtgattgacatatcgtgtccggcggcaggcgctcatcctcatatgctcggtattgccactgcgatcgcctatgcagctgaacgggaactcgcagctaaaagccgtgagaaagagctcgcgctgatcagccgttttggagagagggctgcatccagtgtgccgatggtgctatgcaataacaagcagcacatcatcagtgtgagcataccgattcgaacctcaatgcctgattggcagggccggcacctgtatgagttgaaagaacggggctactcaatcgaaaaagctgtcaccataggagatggcggcacttgtttttatctttcggaacaaaagaaaaagaaggtgttccgattcaatggagtgatcgggaaaagcggccgatcgcaagcgatgctgatgaaccttgaacgtgcagctgcggcagatgcaacggtctgtttgtcgggcgaaactggtacgggaaaggaagtcgcggctcgcgctcttcatgagaacagtgagagacgtcacggtccgtttgttgctgtcaattgcggagcgattccgtctgatttgattgagagcgaactgttcggatatgcagagggcgcttttacgggagcgaaacgaaatggctataaaggcgcctttcaaaaagcgaatcaaggcacattgtttttagatgaaatcggagaaatttcccactcgatgcaggttgcacttttacgggtgcttcaggaacgcaagataacgccaatcggcgggacgaaagaaattccggttgatatcagagttattgccgccacacattgtgatttacgcgagcttgccgaaaacggaaaaatcagagaggacttgttttaccgtcttcatgtctatccaattgaactccctccattacgcgatcgcaccgaggatatcccggatctctttgagtactacaaacagaagaatcattggccaggcgaacttccttctgatttttgtaatgtgctgaagcaatggaagtggccggggaatatccgtgagctgtttaatgtgtttgaacgtctttctatcagatttccggacggccggctgagggatgaatcgcttcccgctttactggaagccgctggattgccggccagctctgcagaaaaaaagccggctgctgccggcgtgcttacctttcgtgagcaaatccaaaaggatatgatgatcaaagcgcttgaatctgcaaaaggaaacgtctctcaagctgccaaaatcagcgggattccccgaagcactttctacaaacgcctgaaaaaattcaacttgtccgctgaatcataaagcatacttccttcaggaaatggaaacgttatgtattgaaggagggtgttacgatgaatattcaaagggcgaaagaaatagtagaatctcccgatatgaaaaaagtaacatataacggcgttcctatatacattcagcacgtgaatgaagaaaacggaacagcaagaatttatccgcttgacgaaccacagcaggagcatgaagtgcagctgaacagcttaaaagaggattaaacaaaaatggcccgcttcataagcaggccattttgttatccgcgcggcgcaaataaaataacacagacaccgatgagacaaatgcatgcgccgatccaatcatacagatcaggtgttttccggtcaacaagccatccccacaggaccgcaagcacgatgaataccccgccataagcggcgtatacacggccgaaggaagggaaggactggaatgtcggaagaatgccgtagacaatcaagatcaatgctccggcgatcccgtagccggctggctttgcctctctcagccatagccaaaccagatatccgccgccaatttcagcaagccccgccgcgagaaataaaagaatggtaaccagcattcatgagcactcctcaagttgcttttctctttcattataaaggaggagagctgttaaagctttggatgattttcaaattcctttaaatacgcgctgcgctgaatctccgtaaattggctgatccagttgcttttcgcctcttcattcagatgagggaggatatagcgttccaccgcttcaaaaaacaatggattcgcgataatgttccaagtagggatgcgaacgacttttccgtctgttttctcgatgataatatcttcaaaaaagatccctttcaagctgtaatgatgccgtcccatataaatccgttttacctcagaaaacatcacgctgcgctttctagagaaaatctcgccatcaggccctgtttttacgctgaaaatgacatttccccggcttgtgaacgccggaaaagccataaaaaatgtgatcaatccataaacgatcgccattaatccgccgcccaaataaagcagggcatacttagattcaaatgtaagagcttcagacaccagccatactcctgcaataaaagcgcctcctgtagcgaggaacagccatattctaaaaaacagcctgcttttgaccttaatnnnnnnnnnnnnntaaagctttggatgattttcaaattcctttaaatacgcgctgcgctgaatctccgtaaattggctgatccagttgcttttcgcctcttcattcagatgagggaggatatagcgttccaccgcttcaaaaaacaatggattcgcgataatgttccaagtagggatgcgaacggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttataacatctttatttgctgttacgatagaaaattcattttgggtaatacctgttaccagccaagtatgatggctgccaggcagaacgaaagccatgtcagccacttccggggagttgtctttgtcataaaccagccgcatcagcgtatccatttttccttttcgcaaagccagatcatttacaaaacgggtaacgtcctcttggtgatcatgcttatctagaaactccttgagatgtgtgggagtgtctgaagcgccctccaaaagcaattcaaattcagttgatgtcagagagatcagtgattctttgtgatcttctgcatctattatatttaaaaactcggatgttttagagagtaatccattagttgaatccatttttnnnnnnnnatgcacctgttcatcaaacagcaattcatgagagtaagtaccaaactttgaaacatggcaggatatattctgttctttaccttgttcatcaaatttggacagcttaactgtatagtcggcgtcgtttaacacatggataaacggacagtattcgtcctttagccgatattgatgattccgatattccgccgcatctttggctaagagtgagcggcacgcggcttcaaataaggcgccgagctgttcatcttctatttcgggaaaataggcttgttttaaggccattccctgttcgaaaaacccttcgctgtaaaaacaaaacaagagttcttctatgctgattgtaaactgcttcattgtttattctcctatccaaatgaaaatttccctttaaggaaatgggttgcgccgtgtatgagcgaatccgctgttttctttgctttttctattccttttttcgcactgtctatccctttatgtatcgttttattcgccgcatctatgtcgtcattcactgatttgacgactttgccggctgattccagtccttttttggctgtatcaacgacagcatggatcggttctttaagttttatcgctgctttttcagcatagactgatgtgaattttgcgattttttccccaacaaacccgccnnnnnnnnnnnnnnnnnnnnnnnnnnngactgtgccgacaggacctaacacacttcctacggcaccgcccacaacagcaccagctgtggcaccgccggcaacaaaaatcgtattattcacagcattcccgacagccttggcgttttcacgcttgagaacttcgggtttgtcctggtattttgcataattttcagcaattttcacgcctgctccgaatgtttcggtcgcaccggtaatcagtgtggcggtaatggcatttcctttcgcgaatctcaagcccgtttttcccacatccttcaaagtggagcgtacgccggcttcattaagaaatccttttgtgtagcttctgacgctgtttgaaaaatccaccgtgtcctgagggaagtattttgtaaactttttatgtaccaaatctgaaaatggacggtttgtctttttcaacaaatatttaggattcaaaagcactcttgccgctttttgataacgtgagctgtcaacggccttggaaatatccaagagcagttttgagtgctgggctgtatgcaagccgcttggctgtttcgcaaattttgtaagccctaatccgtaatattttccctgcgtcagcataagagcggttaagcttgtcatcgtaccgtatttgtcgtaggcattgtagagctttcgcaaaatatcatcttgttccacaaatttatcgcccgtttttctgatgaaaatctcattgtcactcagcttagtgacgagcgcttttcctgagctccacgcatcgcccactccagaaaaacagctggtgtagcggggatcgcattgcaaaatcatctgccccagctccacatgcaggtccttatatttgttttccatatcagttaattcagtgactacatcatttgcaagctgttcgagcttatccggatcaactgcaatgtttcctgacacaccgttcacctcccgagtttatgtctttcctctcttgctttacgctccagttcttccattctggcaatttcagcttttcgttcttctattttgacagcggcagccttcagctcttggcttgtttcaagcagctcctgttcgaattgatcgtaggcggctttcgtttcctcgaaatcctggtcaaacgaatctcttgctttgccctgccaagcatctcccaatgcagataaccgggattcaagcagcattttggagcttctgacctcttctgcggccgcactatacttgtttgccagctcaatgactttatatgagtccaacttttgtcccctgccttttctaaattcacgcacaattggatgttttatataaatgattataaataattcggcatgtatccgaatcgtacaaaagaaccttttcataagaattggaagggcgtatattcacttaaaattcacagttggtgagactttaagattacaaaaaaggtaaaaaaaccaaatctctcagacataaggcaaatgagaaatttcccgctctatgggaaaaaacactaaagttgatcaaatgacctaagtgcgccaaacgtgttacgggacgagctatctcatggtataaatggaattgtaaacgttatcaaggaggtcgtcatatgaagaaaaaatcattctcaatcgtaatagcgggcggagggagcactttcactccagggatcgtactcatgctcttggaccatttggaggagtttccgatcagaaagctgaagctgtatgataatgataaggagagacaggatcgaattgcaggcgcctgtgacgtttttatcagagaaaaagcgccggatattgaatttgcagcgacgactgacccggaagaagcttttacagatgtcgattttgttatggcgcacatcagagtagggaaatacgcgatgcgtgcgcttgatgagcaaattccgttaaagtacggagttgtcggccaggagacgtgcgggccgggcgggatcgcatacggtatgcgttcgatcggcggtgtgcttgaaatattagattacatggaaaaatactcgcctgacgcgtggatgctcaattattccaatccggcggcaattgtggctgaagctacgagacgccttagaccgaattctaaaattctcaatatctgtgatatgccggttgggatcgaagaccggatggcgcaaattcttggcttatcctcaagaaaagaaatgaaggtccgctattacggattaaatcacttcggctggtggacatcaattcaggatcaagagggcaacgatttaatgccgaagctgaaggagcatgtatctcaatacggctatattccgaaaacagaggctgaagcggtggaagcgagctggaatgacacattcgccaaagcgcgtgacgtgcaggccgcagatcctgatacactgccgaatacgtatttgcaatattatttgttcccggatgatatggtgaaaaaatcaaatccgaatcatacgcgggcaaatgaagtgatggaagggcgcgaagcttttattttcagccaatgtgacatgattacacgtgagcagtccacagaaaacagcgaaatcaaaatcgatgaccacgcatcatatatcgttgatcttgcccgggcgattgcctacaacacaggtgaaagaatgctgttgatcgttgaaaataacggcgcaattgcgaactttgacccgactgcgatggtcgaggtgccatgcattgtcggctcaaatgggcctgaaccgattaccgtcggcaccattccgcaattccaaaaagggcttatggagcagcaggtatccgttgagaagctgactgttgaagcgtgggcggagaaatcgttccaaaagctgtggcaggcgctaattttgtcaaaaacaatgccgaacgcgcgtgtggcaagactcattctcgaggatttaatggaggccaacaaagacttctggcctgagcttgatcaaagcccgacccgtatatcataactgaaattcccccattttcgaatctgtaattgtatataatagaaagaaaatggggggatctgatatgcagctcgaagaactgatcaatcagcactacagcaaattgaatgacaacgattttcatattttaaaatatatattgaatcataagcacacatgctatcaccttggaatcgacgcgctggccaaagcttgcagtgtatcgcgttcctcaattttacggcttgcccaaaagctcggtttcagcggttacagtgaatttcgcgtctttttaaagtgggaagatcagccggaagaaggcgagagtatgagttttgaaaagctgcttgatgatattgaagcaaatttgaagttcttacggacaaaggacatgacggacatgtgccagctgattgatgaagcggaccgcattttcgtctacggttctggaaatgcgcaaaagatatgcgcccgcgacctgcaaagaatgtttattccgcgccatcgctatcttattttaattgaagatacaaatgaatttaatttgatgcgcgatgattttaaagtaaatgatctgtttatcatcatttctctttccggagaaacaccggagctgattcctcaggcaagaatgctttctgcaaagggtattccctttatttccattacgaatttaaaaaacaatgtcctcgcccagctgactccgcataatctttatgcgacaagcaaacctgtgacattaagcgataaaacggaaattgtcgcttttgcaccgttttttctcgttggcgaagcattgttccgcgcatatgttgattacaaagaggcagaaaaaaatgacaatgactagcagggggttctggtatgatgcaaaaaattcagcgctttggaagcgcgatgtttgtgcctgttttattattcgcgttcgccggcattatcgtcggtatcagcacgctctttaaaaataaaaccctcatgggcccgctcgccgatcccgacgatttttggtatcagtgctggtatattattgagcagggcggctggactgtttttaaccaaatgccgctcttattcgccattggcatcccggttgctttggcgaagaaagctcaggcacgcgcttgtttggaagcgcttactgtttacctgacattcaactattttgtcagcgcgatattgacggtatggggaggagcatttggcgtcgacatgaaccaagaggtcggcggaacgagcgggttaacgatgattgcaggcataaaaacgctcgataccaacattatcggagccatctttatttcttcgattgtcgtctttttgcataaccgctattttgataaaaaactgcccgattttctcggcatctttcaaggctcaacatatatcgtgatgatttccttctttattatgattccgattgccttggctgtgtcttatatttggccgatggttcaatcgggaatcggctcgcttcaaagcttcctggttgcttctggggcggtgggcgtttggatatacacgtttttggaacggattttaattccgaccggccttcatcactttatttacacgccgtttatttatggcccggctgtagcggaaggagggatcgtcacgtattgggcacagcatctcggcgaatattcgcaaagcgccaaaccgctgaaggagctctttccgcaaggcggattcgcgcttcacggcaactcgaaaatcttcggtattccgggtatcgccctggctttttatgtgacagccaaaaaggaaaagaaaaaactcgtcgcagggctgctgattcctgtcacactgacagcgattgtcgccggtattacagagccaattgagtttacgttcttattcatttcacctttcttatttgcggttcacgccgtgcttgccgccacaatgtcgacagttatgtatatggccggcgtcgtcggaaacatggggggcggactgatcgaagcggtaaccttgaactggattccgctctttggaagccacggtatgacatatgtatatcaaattttgatcggactctcgtttacagcaatttattttttcgtcttcagatttttaatcctcaaattcaatatcgctacaccaggacgggaaaaggatgaacagcaggaaacaaagctatattcgaaaaaggaatatagagaaagaaaaaacaaggatgaaacggcctccgctgctgaaacggctgatgacaccgcttttctgtatattgaagcgctgggcggaaaagacaacatcactgaagtcacaaactgcgcaacccgcctcagagtcagtgtcaaggatgaaacaaaggttgaacccgacaacgtattccgcgcgcttggcgcacacggcgttgtcaggaacgggaaggcgtttcaggtgattatcggattaagcgtaccgcagatgcgggagcgtgtggaaaaattactgaatgaataaannnnnnnnnnnnnnnnnnnnnnnnnnnnnnnnnnnnnnnnnnnnnnnnnnnnnnnnnnnnnnnnnnnnnnnnnnnnnnnnnaaaaggggtttggaggcttttacatgcaaaaggctttgtcgtttttaaaaccatattcattgctggcgggaattgcgctgattcttatgttgacggagcttgcagttgaactgctgcagcctttattgattgcgaaaatcatcgacgatgggatattgaagcaagatctgcggcatgtttggatatggggcgcggtcatgatcggactgaccgtgttatcctttgcggcggggatgctgaattccttttatgccgcccatgtcagccaaagcttttcctatgatacgagaaaagggctttttcaaaaaatccagtccttttcctattccacatttggacagttttcgtcctcttcttatattacaaggctgacaaacgacgtcacacaggttcaaaatatgatttttatgagtttgcggtttatgctgcgggctcccttaatgattgcaggcggcattgtgctgtcgcttgccgttaatgtgaaactcggcttttttctgcttgtgaccattccgatcctgatcttgtttttgctatgggtattaaggaaaggcggggcactgttccgctcagtgcagaaaaggctggatcaagtgaacaccatcatgcaggaaaatttaattgcaatcaagctgatcaaagcgctgcttcgcggcagccacgaagtcaaacgatttatcaaagccaacacaaggctgatggaaaaaacggtttcggcctttcagcttgtggaattcacgatgcctgtactgatgctgatgatgaatctctgcatccttttgattttgtgggcggggtcctacagtattacgagcggaagcactcaggttggcgatgttgttgcgataattaactacgcaacacgaattacaggcgcgctttcgatgtttccgtttttgattatgattttcacccgggcgaaggcttcaggggatagaatcggtgaggtgcttgaaacagaaggcgacgagcgggaggaaggcatcatatctgatcgtttgtcaggacggattgagtttcagcatgtatcctttcgctatcctgaaatggacagagaagcgctcaggaatgtctcattttccgcaaagccaagagaaacgatcgcgattctcggtgcgacgggctcgggcaagtccacgctttttcagctcattccgcggctttatcagccggattcaggccgcatttacatagatgaaaagccggttcaagattttccggctgaagggctgcgcaggcaaattggatatgtaccgcaggaagtcctcttgttttccggcacaatcaaagaaaacatcgcttggggcaaagaaaatgcttcactagatgaaataatggatgcggccaaacatgcgcaaattcatgaaacgattttgaagctcccaaatggatatgacactgttttggggcaaagaggcgtcaacctgtccggcggccaaaagcagcgaatttccattgcgcgggcgctgattcgaaaaccggctatccttctattagatgacagcacaagcgcacttgatctgcaaacggaggcgaagctgcttgaagcaatcagcacataccattgcacaactttgatcattacacaaaaaataaccacggcgatgaaagctgatcagattttgctgcttgaggacggcgaactgattgaaaaaggcactcacagtgagctgctttctgaatctcagttatacaagcgcatttacgagtcacaattcggaagggaggggagcgagtcatgctaaaagacatccgcaagcctttccaatatcccaaactgccaattgacaaaaaagaaggcgcgaaaaagcgggccaaagcaaaggatacaaagggtacactgagacgaatctggtcttacttggctgaacgaaaaggactgctcatacttgtcatgctgatggttgtcatcagcgcgatattcgggctccttggcccctttgtgatcggaaaggccatcgaccattttatcgtcgggaaaacggtcagcggcttgattcccgttttgcttcttctgctcgctatctatatcattcagtctctgtcgctttggtttcaaaactattggatgattacgatctcgcagggcacggttttcagaatgagaagcgaattgttcacccatctgcatgagctgccgattccattttttgataaacagcggcacggcgagctgatgagccgggtgacgaatgacatcgaaaatgtcagttctaccttaaacacgtcagtcattcaaattttgtcaagcgtgatcacctttgtcgggacgattgcggtgatgctgtacatgagcccgctccttacattgattacgctgaccattattccggtgatggcagcgagcctgaaatggatcaccaaccgaacgggaaagctgtttaaagaacagcagaaaaaccttggtgatctgaatgggtatattgaggaatctgtttcaggcgcaaaggtcatcaaagcatattcacgtgagaagcagattactgctgaattcctcgaaaaaaacgctgcactcaagacgtcgggcttttgggcgcagacgatttccgggtttatcccgaaggtcatgaactctttgaataacttaagttttacaatgatagcggcaatcggcggtttgtttgcgctgaaaggctggatctcgatcggctccatcgttgtctttgccgagtattcaagacaatttacacgccctttaaacgatctggccaaccagtttaatacgatgctgtccgcaatcgccggcgctgaacgggtgtttgacgtgcttgatgaaaaagaagagcgcgaggatgaaaagaacgccgtgcatcagcccatccaaacaggcagcattgaattccgggatgtgtccttcggttacgataaagggcagcagacactgaagcatttacagtttaccgtgcctgcagggcagtccatcgcgtttgtcggaccgacgggggcggggaagacaaccgtcactaatcttctcgcccgtttttacgagcctaacgaaggaaaaattttaatcgacggtacagatattaaaacccttactagagcaagcctgagaaaaaacatggggtttgttcttcaggattctttcttatttcagggaacgatcagagaaaacattcgctatggcaggctcgatgcttctgatcaggaagtcgaagccgctgcaaaaacagcgaatgcccatagttttattgaaaggctgccaaaagggtatgacaccgtgctgacgcaaaacggttcgggcatcagtcaaggacagaagcagttgatttctatagcgcgggcggtgcttgccgatccggttcttctcattttggatgaagcgacaagcaacattgataccgtaacagaagtcaacattcaagaagcgctcgcccgtttaatggaaggaagaacaagtgtcatcattgcccacaggctgaacaccattcaaagagcggaccagattgtggtgctaaaagacggtgaaatgattgaaaaaggcagccatgacgagctgattcggcaaaaaggattttacagtgacttatatgaaagccaatttgagaaatagacctttgtcctgcacagaggtcttttttgttacagatttatagtacttttatttcattttcgtaaaatgtaacaaaattacttgacgtaaacaagttatgtatatatactagcttacattaagtaagtgataacatttatcaaggaggataaaatgaataaatcatttgaaattggcacattacttttaagagttattacaggtattatcttttttgttcacggtttatcaaagtttcagggaatggagggcaccatccaatttttcggcagcataggccttccaagctttatggcgtatgtcatcgcagcgattgaactcattggcggagtgcttgtcttcttcggattggctacacgtattgtcggtgtactgttcgctcttacactgatcggcgccatcatcactgttaagctgaaagcgccattcatgggcaatgcagaatttgattaccttctgcttttgacatccattcacctggcgcttactggaagtcgattcctggcgctggacccatttgtgtttaaaggaaaaaagaacgaaaacgtttcagcataagaaaagaggcatgcagcatgaccagcattcatgaggatacacacattggctatgccaaactcacaattcgcagtctggagcgttcgcttcagttctactgtaacgtcatcggttttcaagtcttaaaaaagacggatcgccaagctgaattaacggctgacgggaaacgcgtactgcttattcttgaagaaaatccgagcgctgtcgtcttgcctgaacggtctgtgacaggcctttatcactttgcgattcttcttccggacaggaaagaacttgggatcgcgctcgcccgcctgattgaacacggcattgctatcggacatggagaccatgctgtcagcgaagcgctctacctgtctgatcctgacggaaacggcattgaaatgtacgctgaccgcccccgcagcacgtggcagcgtgatcgggaaggaaactacgtcatgacgacaaccgctgttgacattgagggccttctggaagaggcgggagatgagcggaaaacatcgcttccgaccgatacaatcatcggacacattcatctgcatgtcagtgatttgaaagaagcaaaggcgttttatacagatgtactgggctttgacattgtcggaaactatgcgggcatgtccgccctcttcgtttcagccggggggtaccaccatcatatcggcttaaacatttgggcgggaagaaatgcgccgcctaaaccgacaaatgccagcggactagactattacactgttgtcctgcctcaccaagaggagctggatttagtggcaaaccgagtcaaacatgccgggtattcgattgaagagacggaaaacagctttcgtgtgaaagaccctgtttccggcgcctatattacatttgtgatttaactgcaatccccttgccgaaataacggcagggggattttttatttttgtccgccttgttatgatgagagaaccaacttgttaggaggcgtttacatggaactcaaccaccttgtgacgggcaaaatagcattaaatcaatatgtgcatcgcttagagcaaaaggatgtttcattttacgtccactactggggagcgatgacgaaccactataacacactgcttcataagcattccttttatgaaatttgttacgtggtaagaggtgaaggatattaccttgaaggcgatcgtacatatccgcttcgtgaacagacgatttttttgtcaaagccggagcatttgcaccaaatcaaaagtgaaacagggctgttccttttttacgtcgctttcgagctgagcgaggatcagtcaagcgccgaatggatcaaagtgatggaagaagtgaaacaaagcccctttatcacaatgcaattgaaagatggcgaaccgccgggcctgctttggaaaacgttaatgctgcaagcagcgcaacctgtcaatgcttttgacaaagagatcctatctcatttgtcgcatgcattgatcctgtcattaatccaaacctttctcccgtacgcccaacgcccgaaacaaaagcagcccattcacacatcttctgctttgctgacagaggtgaaactgcacataaaagacaatctgtcacagccgttaaagctgacggatgtcgctagccactttcatatctcagggaggcatttatcacgtttatttgcagcagaactgggcgtcagctactcagaatttgtccaaaatgaaaaaataaacaaagctgccgaactgctgaaatcaacgaatttgtcgattaaagaaatagcggaagaaatcggtttctcagtacattatttcactcgcgtcttttccgctaaaatcggcagctctccagggcttttccgctccctttataaagactcaaaaatgaccgcatttcaaatcaataaaccttttcaaaaaatcgaacaggccaagccgcacgaataagatgtcctgaaatgacaaaacaatgtcttcatatgataaagacgcgagaaatctcgttgtcttataatctttttagaaagcggttacaacaaggggtattgctgaaggagggatgcattggcttatgcttggtgtcgggtgctctgccattcttgaaagaaggggaagaaagccgtgagtacaaaaaagaaagaggctgtaataggaaaagaaagcttagctcataaagggcttttacgaacgattacattggtatctacattcggcggcctgttgttcggttatgatacgggtgtcattaatggagcacttccttttatggcaactgcaggtcagctgaatcttacacctgttacagaaggactggttgcgagttccctgcttctcggggcagccttcggggcgatgtttggaggacgtctgtccgatcggcacggccgccgaaaaacgatcctttatttagccttactcttcatcgcagccacacttggctgtaccttttcaccaaacgcgtccgtgatgattgcctttcgttttctgcttggactggcggttggctgcgcttctgtaacggttccaacctttttagcggaaatttcgccggcagaacgcaggggacgaatcgtgacacaaaatgaactgatgatcgtaattggccagcttctggcatacacctttaacgccattattggcagcacaatgggggagagcgcaaatgtatggcggtatatgctggtcatcgcgacacttccggctgttgtgttatggttcggaatgctcatcgtgcctgaaagcccgcgctggctggcagctaaaggcagaatgggtgacgccctgcgggtgcttcggcaaatccgtgaagacagtcaggcacagcaggaaataaaagaaatcaaacatgcgattgagggcacagcaaaaaaggccggctttcatgattttcaagagccgtggataaggcgcattctattcattgggattggaatcgccatcgtacagcaaattaccggtgtcaattcgattatgtactatgggacagaaattctgagagaagccggttttcaaacagaagctgcattaatcggcaatattgcaaacggtgttatttcagttattgcggtcatttttgggatatggcttctcggcaaagtccgtcgccggcccatgctgatcatcggacagattggcacgatgacagcccttctgctgatcgggattttatccattgtccttgaaggaacacccgccctgccgtatgttgtgctgagtttgaccattttgtttcttgcgtttcagcagactgccatttctacggtgacgtggctgatgctctcggaaatctttcctatgcatgtgcgggggcttggcatggggatcagcaccttctgcttgtggacagctaactttctcattggattcacctttcccattttgctcaatcatattgggatgtcggcgacattttttatctttgtcgctatgaatatcctagcgattctatttgtgaaaaaatatgtgcctgagacaaaagggcggtcacttgaacagcttgagcattcctttcgccagtatggccgccgcgctgatcaggaaatccaaaatcaaacaactcacttatcgtaacctgagataccaggaggaatctatcaatgaaactatcttatgtaacagacagcctagggcatttgccttttgaagacatgctcgattttgccgcaaagcttgggatcgatacacttgaaatgacaaccgggggctggtcgccggcacctcacttgaatcttgatgaactgctgcaaagcagcgaaaaaagaaaagaattctcacaagcgctggaaaagcggaacatgacactttgcgcgttaaactgttcggggaaccctttagatccgggtgaattgggcaaatcgcacagagacataactgacaaaacgatggagctggctggattattaggcgtcaaaaaagtgatcatgatgagcggtttgccagccggcggcccggacgacaaagtgccgaactggatcacatacacagtaagctggcctcccgttttaaaagatatcctcaactatcaatgggaagacgttgcgatcccatattggaagaagcttgtcaaaaaagcggaggcctgcggcgtggggaaaatagcgcttgagaacttcagctctcaattagtctataatcctgagactctctttcggctcagaaatgcagtcggcccgatggtcggtttgaatcttgacccgagccatttgttatggatgggcgcagacccgatcatcgcagcaagggagctcggctcagccattcaccatgtccacgggaaagatgtcagaattgaaagatatttatcggcggtcaacggacttttagaaacaaaagaagtgacagatcctgcaaaccgggcgtggaattacgtagctgtcggctgcggacaggatttacagtggtggaaggaatttttttcagttgtaaaaatgatgggatatgaaggtgaggtttctttagaaatggaggatctgacgatgtcacctgaagcgggcatccgtacttctgtagaagctttaaaacaaaccatcagccaataggaggttttcatgatgctaaatggagaaagaatcatctctaagccgcttcgctgggcaatggtaggcggcgggcggctcagccaggttggatataaacatcgtattggagcgctgagagacaatactgcttttcaattaactgctggcgcttttgatatcgatgccgaaagaggaaaagatttcggggtgaaccttggagtggatgcggaacgctgttatcccaactatcaaaccatgtttgccgaggaagcgaaaagacaggatggcatagaggtagtatcgattgccactccgaacggcactcattatgagatttgtaaggcggcgcttgaagcaggagtgcatgtcatctgtgaaaaaccgctgttcttcacttcagcagaggggcaggaaatcaaagcgctcgcagagaaaaaagggaaaattgtcggcgtgacgtacggtttttcaggcaatcaaatgcttcttcaaatgcgtgcgatgattgaacaaggaatgatcggcgatattcgcgtggttgacttgcagtacacacacggtttttgtgcaacagatgaaggtgaaaagataagcgctgcacagaaatggcgtgtcgaccctgcgatcgccgggccaagctttgtgctgggcgatttatctacccacacgtattatatgtcacagcttattatgccaaagatgaaaattaaagagctgctgtgtgaccgacagagcttcgtcggcagccgcgcaccgctagaggataatgcccatgtgctgatgcattatgaaaatggagcggtcggaacgatgtggacatcgtcaatcaatgccggatgtatggatggccatagaatccggattgtcggctcaaaggcaagcattgagtggtgggacagcatgccaaatgaactgacgtatgaagtgcagggagagccgagccagacactcgttcgcggcatgccgtatttagatgatgtttgcagcgccgatgaacgactgggcgccttacacagcgaagggctgtccgaagcatgggccaatatttatcttaaatttgccattgcgatagacgccaaaaaccgtaaagatgaagaaaccttgaacaacttggtttatcctgacattgatgcagggatcgagggcattcgctggattgagaactgcgtgcgctcggcaaaccaagggtcagtttgggttgaatttaaataaatgagggaatgcgccgcatatgacataaagttcatatgcggtttttattttccagaaactcctgtcaaaaatgccctgaggcaggtatgataagaagggaattgggtatcgggagtgatgagcgtgaaagctcttttttttacgagaatgttcaccttgatggtgagctgtttaatgtatctgtccattgtgaaagaggataactggtttggatatgtatttatagcagcaggtgctgccatgtatgcagccaatcatgttttgctgacaaaagagacaaatgccatctggttctgcctgattgatattgcaatcggcttttcgttcggatttatctttcccggcacaggtttgttcattattatgctttgtccggttgcggtcgccttttttctgcgggggtttcctaaaagaacagcatggtctgtcttatgtctttcctctattttatttttgaccgtcctcatccgtacatatgcgatgttcggcaatgaatttgtcattgatcatttgactagcatgacattcgttgtcttctgcggtgtcgtgggcaaattaatccgcaagctgttggatgcgcaggatacggcaaaacagcagtttcaggaactgacggagtcccatctggcgctgtctgctgcacatcaggagctccatttatatgcgaagcaggttgaagagctgactgccatttacgagcggaacagaatggcgcgggaaatccatgatacagtggggcataaaatgacggcccttctcgtccagctgcagcttttgcgtgaatggcaaaaaagagacagccaaaaagcggatgagacagtaggtgtctgtgaaacacttgcccgtgaagcgcttgatgatgtccgcttatcagtacgcactctgcaaactgaaaacgatccttcgctaatcgaatcgctgaaacagctgacagaggacttttgcaaaaatgcaggagtcacaacagaatttgcggtcagcggtgatcctgcaatcatcccgctgtctctccatccgacactgatcagaacggtgcaggaagcactgaccaatgccaaacggcacggcggcgccgcagcttgttcgatacagcttgcctgcacaacggacagcatcagccttgtcattaaggatgacggaaaaggcaatcccgaagcggcacttggctttggcctcttgaatatgaaaaagcgggcagcggagcatggcggaacgatccgctttgaaagcgaacgggatcaaggatttactgtgaatgcagaattttcacttgccaataaaaaatggagcttcaggcccgtgcagcaaaaggagagtttatcatgattaagatcatcattaccgacgatcaggatatcgtcagagaagggctggcatccctgctccagctccgagaagagctcgatgtgatcgcaacggcgcgaaacggacaggaagccttcgaaaaggcgaaagagctggagccggatatcgtgttaatggacatccgcatgccggtttccaacggggtggagggaacaaaattaatcacaagctcgctgcccggcgtaaaggttttgatgttgacaacctttaaggattcagcgctgattgctgaagcgcttgaagaaggagcaagcgggtatctgctgaaggatatgtcggcagatacgattgtaaaagcagtgatgacagttcattctggcggaatggtgcttccgccggaattgactgcccaaatgctgaatgaatggaagcgtgaaaaacagctgaaaggaataaatgagatagaaaaacctaacgagctgctcgacctgaccgagcgcgaaattgaagttctggctgagctggggtacgggctgaataacaaagaaattgccgaaaagcttttcattacagaaggcacagtcaaaaaccacgtttcaaatatcatcagcaagctggctgttagggacagaacccaagccgccatttactcggtcagatatggtgtatctgtcttttgacatatgacgttttgcatatacgcttctctgaaaaggccttttgcaggcctttttttcatgccctatgttctatctgccgctacatgccgcacgcctttctttcttctacaatggcaatggatcaaaaaaaggagtgaaacgacttgctgcaagcagaaaacatcaaaaaggcatatggaaaaaaaacaatcgtgaaaggcatttctttttcccttcaaaagggggagtcgttcggtctgctcgggccaaacggtgcggggaagtccacaaccatctcgatgatttccggccttgtgccgcatgacagcgggaacatcaaggtgggcggctataatatcggaaaagaaacggccaaagcgaaacaaaaaatcggcattgttccgcaggaaattgcattatatccgacgctgacggctcatgagaatcttatgttttgggggaaaatgtacggacttacgcacggtgaggccaaaaaaagatcggctgaggtccttgaatatgtcggtctgactgagcgggctaaagataagattgaaacattttccggggggatgaaacgaagaatcaacatcggtgcggctttaatgcataagcccgagctgctgattatggatgaaccgactgtcggtattgaccctcaatcgagaaatcacattttagaaacggtcaaacagctcaatgaaacgggcatgacggtgatctatacgagtcattacatggaagaagttgagtttttatgcgaccggatcgggataattgatcagggggaaatgattgcgattggcacaaaaactgatttgtgcagccgccttgggggcgataccatcattcagctcacggtcagcgggatcaatgaagcgtttcttgtggcgatccgatctctggcccatgtgaatgatataacagtacatgaattagagctcaaaattgacatttctgcggctcatcatgagaaagtcgtcaccagcctgcttgctaaagctgctgctcatcatataaacctgctgtcccttcaggtgcaggaaccgaatctggagcgcctgtttctgaatctgaccggccgcacgttgcgggattaggagggacggctatgaaaaaaagcatatggatcgcctggaaagatgtcaaaatcagaatcacggacagaaaaggatttatgctgcttatcctaatgccgctcatcctaacatgtattttaggcgcagcgctcggatcagttgttgacggaggcagccggattgatgacatcaaagtcggctacattcaatcagaccagtcagatgcagcaaacatgtttacaaaagatgttctcaaaaaaatgaagtcgataaaggtcacaaaagccggcagcgaagacaagatgaagaagttgattgatgaaaagaaaatcgatgtaggcatcgttatcccgaaccattgggaagccggcaaaacctcagctgttgttaatgccgctcctgatcaaacattgaaaagttccatcatcgaaacagctgccagctcttttattgagcaatataaagcggtaaaggaagccgcgtcagcctcaatggactacatcagcaaaacggaagctgtaaagcaaggaaaacttgaccctgcacagtttgcagaaaagctggcaaagacacttgaaaaagaaacaggtgacaagcttactattgcggaaaaatctgtcggcagcaaggccgttaccagttttcaatactattcggcggcaatgctttgcatgtttatgctgtttcatatgacagtcgggtcaaaatcgtttttacaggaaaaggatacggagacgcttgccagaatgctgatgacgcctgcgcaaaaatccgtcattctcttcggaaaatggcttgggacgtatctgtttgctatcatgcaatttttcatatttctgatcgtcacaatcaatgtttttggtgtggactggggcggcaatttgctgtttgtgagtgtactcgggctttcttacgctgccgctgtatctggcatttcaatgctgcttgcgtcgtgcatcagcgatatgaaatctgcagactcgataggcggcttcggcattcaattgcttgcggttctcggcgggtccatgctgccgctgtaccaatttccggacgtcttgcagtctgtatccaaagcggtgccaaatcgctgggcgcttgacggctttctttctttaatggaagggggaggctgggctgaccttcaaaagcctgtgcttctttttgcggcgatcggtctttgttcacttgtaattggtatcagacggcttcatacaagataaggaggtacaaaaggtgaaaaaaatcatagccatttgcggcattgagctttctctcatttttaagaagccacagaactatttgatcatgtttgctgccccgcttttgcttacctttgtatttgggagtatgctcggcggcaatgatgataaggtgcggcttgcaatcgttgatcaggacgatacgattctctcacagcattatattcggcagctgaaggcacacgatgatatgtatacattcgaaaacgtgcctgaaaacaaagcgtcagaaaagctgaaacaaaagaaaattgccgggatcatcgtcatttcccgctcgttccagacacagctggaaaaaggcaaaaatcctgagctgattttccgtcacggccccgagctgtcggaagcgctgatggtcaaacaatatgcagaaagcacattggcaacgctcaatattcaggtgaccgcggcgaaaacggcatctcagactgcgggagaaaactggaaggcggcgtataaaaccgttttcgccaaaaaacatgaagatacggttccggctgtaaaacgacagatgctcagtgataaaaaagagggtgcggaagcaagtgacacagcctccagagcagcaggtttttccatcctgtttgtcatgctgaccatgatgggagcggctggaaccattttagaagcaagaaaaaacggcgtctggtccagattgcttacagcctctgtcagccgagctgaaatcggtgctgggtatgtgctgtccttctttgtcattggctggattcaatttggcatattgcttctttccacccattggctgtttggcatcaactgggggaatccggctgcggttatggtgttggtgtcgctttttctattgaccgttgtcggcattggattgatgatagcggccaatgtcagaacgccagaacagcagcttgcgttcggcaacttgttcgtcatcgcaacatgtatggtgagcgggatgtattggccgatcgacattgaaccgaaatttatgcaatccatcgctgaatttcttccgcaaaagtgggcgatgagcgggctgacggagattatcgctaacggtgcccgcgtcacagatattctcggaatctgcggcatcttgcttgcatttgctgcgatcactttcgcagcggggctgaaagcgctccgagcctaaaaaacatctgccgtttaggcagatgtttttttgcatgtgggtacattcgtatgggtgtagcctgaactgcggttaatccttatcgatcatagctaaaattgattccagccaagaaacgtaatttttttcccgctccagcgctttcgtcagcacaagatagtggccgaagtctggtgaagaaaatgacatcggctctgctgaagccataagcttttcatagcttccctgtaagtcagaaagcttggcctggcgtttttgcagctggtctttgaacaaatcagaagcctcctggcgcgatagacaagaaatgaaataagccttcagcataaattcatccttcaccgtctcgggtatcggctggtggcggatcagccagtcatgcagctcctgctttccgctgtctgtcagggtgtacatctttttctccagctttgtgccctgaatcgttgtccggaacgtgataaatccttcatccgtcagctttttgagctcagggtaaatctggctgtgcttggcgctccaaaactggccgagctcctctttaaaataactcgtaatatcgtatccactcaattcgccttttcgcaaaagccctaatatggcgtattttaatactctcatgctatcctccgtgtctggctgtttcgcaaaacagatgagccggtgctcaactgtgattctaactgcctattccccttattatagaaaagggaggaagggaacacaaccgggctctttggaaatgaagataaaaggtttgtcagaaggtatccgatttatcaccgtcaatataaaagagatttaaatttaattttcagaaaaaatattaaccatattgattttttatgtataataggaaattggtggtatcaacatgttaagggggaataaacgtgaaaaaagtacttatggcatttattatttgtttatcgctgattctatctgttttagccgctccgccgtctggcgcaaaagctgaatcagtacataatcctgtcgttcttgttcatggaataagtggtgcatcatacaactttttcgctattaaaaactacttaatttctcaaggctggcaaagcaacaaactgtacgcaattgatttttatgataaaacaggaaataacctaaataacggcccgcagcttgcttcatatgttgaccgtgttttaaaagagacgggggcaaaaaaagtagatattgtggctcatagtatgggaggcgccaatacgctgtactatattaaatatttaggcgggggcaataagattcaaaatgtcgtaacgcttggaggggctaatggtttagtgtcatcaacggcgctaccgcgcacagaccctaatcaaaagatcctctatacatctatttacagtctcaatgatcaaattgttatcaatagcttgtctcggttacaaggagcgcgaaacatccagctttatggcatcggtcatattggcttgctttctaatagccaagtgaacggctatatcaaagaagggctgaatggcggaggcctcaatacaaattaatatcttcataaaaaacctgcagtctccgatacggcaggttttttnnnnnnnnaaagccagaggggtttatgaccttagtctatcatgcatacgtcaatttatgacatcaggcactttttcaaatagagcggacatgttaaggtacaaccatcgatttctataaatttgaaataaaaggagcgctgttatgcaaattaaagaaatttttatgatccgctgcatttcgtgcttaagtgtcgtcttgctccatatcatttcaatggtcctgatgcttcaggcagaagctcttgcagatatttctcacactgttgattctttccgcacactcctgatgttcagcacgcccgcttttattttcatctctgaatttttactggcccgttcttatcctgatggggtgcctgacggttttttaaagaagcggggaaaagtgatttttgttccttttctatttatcgcggccatcgatgcgctgctgatgaccagtgcgatggggggagaggtaacctttctcgcgtttgtgcaaaaatatctggagaacgtattcttaggaaactttatcggatacttcattctcgtcatctttcaattttacatgctgcatatgatgtttcatgagtatttgaaaaaagcatcgccgaaatgggtgctgtctatctcatttgtggtgacagccgcttatttaggctatttctcagcagccagcccggctcctgcttctgaagagggcggggcatttccgttcttctgggttccgttcgcaggctggcttttctacttttgtctagcctactattgcggaaaagaatacaagcgttttttagcgctgctgaaccaataccgctgggtggtgtacggcgccgcaattgcttctggggcgctggttgtcactgtttcttatgtcggtgaaatcggcatgatcagctcgaaacggcctgatatcctgctgtattcgacaagcatgcttttcttatgctttcacttgttttctaaaatgaagcatgtgccgaaaatcatgatgtttatcagcaactattccttttcgatttatctgcttcatgcctattttatgattataggctacgtgttgcttttgaatatgcccgaaattcctgccgtaccggctgttctcctgctgtttgccgtgtgtacagccggcccgattctgacctcgtgggcactgaataagttcaaatatgggtatttatttgtggggaaaatttatcagccaaaacagaagaaggtaacagtcgaagtgcgtgatcacgcagggtgaaaaacaagcggcaggggggctcctgccgcgtttctttacttctcatccgcttgcagaactgtttttaaatatagttttgcagactcagcaagtccagatacatcagctttttcttcatcgaaatacagggcgttttgaatgatgccgtcattcatattgaggaaaaacttggcgatagtcgcaagaggctgaagcggctgaaactctccctgatcgatccctttttgcaatagctttgaaaatctttccacaaaaagatcataccttttctccaaatactgcctacgttcctcattccgccaagctgtcactaaatattcaaattgcaccggcgccagcgtatctgctacatcacgcaggccctcagacagttcatccaaatagattgaaatggcggaccaaacactttggtgttcagctgatttatcaagctttcggagtccttcatccagccctgtttcaataatgcggcgaaacatctcctcagtgcttgaaaaataaagatagacaccgccccggctgaaacctgactcttctacaacgtccttcatcgtcgttaattcgaatcctttacgtttaaaaaccgttttggcagcctctaaaatctttgcctgtcgtttatccttgtgctcctttgttacttttggtgacaagatatcgcctgctttctgaaactttcttacctacaagtgtaatcaacccaatcaagatcagcaagcagccacagacaagaaaagcaagtgaaacaccgatccattccgccagcatgcctccgcccgccatgccgaggatggaggcgagggttgtcgcgctctgaatggcgccaaacaccctgccgctgtaatcaaccggcactgttgtttgcacgagaatttgaaatggaatatggaccagaccaaaagccgctcccatgatgaaaaaagcgaaaataaaaagagcaatgccggcaattcccattccgctcagaaatggcacgcctccagttgctagtccaagcagaaaggtcccagctgagaaataaagaaaataagaggtgattcgccgtctgccggcaattgccgccgtaaggagcatgccggctccgctgacggccatgcaccagcctgcaagctcaggcggagcgcctgaaaaagaacggataagaatgatagcctgggaatcaccaatctgcaaaacaaagagaacgacgcaagctgtgagtaagcctattaaaagaagcggcatccgtttcaaatactgaaggccttctttaatagaagcaagtgctgatgttttttcttgaggtgtattggctttttgtaaaaaagcatctttggggaggaaaaacaaaatgacagcggaaagaagaaaggcgccggcgttaatatagaaaacagaatgtatagagacagcagcgatcagcatgccgccaagggcagggccgaagatttttgcactgttatcaatgatgctgctggcggaaacagcctgctgaatgtgtgcttccggagccaattccttaagctttccgtttttagcaggtgaaaaaagtgaagaaaaacagctctgaaggcatagcaatacgtaaagctgccaaagctcactgacataaacgcagctgataacggtgagggcacgtccgatttcagacagaaacatgatcgtttttctgtcaaaacggtcggcaagcagacccgatacaggtccgagtacaatgacaggcaaagcaaacgacatcattaaaagcgacatatctaatggagaaacatgaagctgaaaagcggctaatgttagcacggccaaaatgtgaagccagtctccaagtgaagaaatggtttgcgaggctaacagtgtcatcagtcctttttgattgcgaaacaacggtttttccataattcatcctcctgattattaaaatgacactagtgtcgtttttattgtatgggaaaaagacacaatatacaatctttttcttgtaaaataaaggagaagagtgaaaagaagggggaacatgcatgacaacagacaacttaagctacccaataggagaatacaagccgagggaatccatatcgaaggagcaaaaagataaatggattcaagtgcttgaagaagtgccggcaaaattgaagcaagctgtagagggcatgacggacagccagcttgacacaccgtaccgggacggtggatggaccgttcggcaagttattcatcatctggctgacagtcatatgaacagctatattcgttttaaattgagcttgacggaagagacaccggctatccgtccgtatgatgaaaaagcatggtcggagctaaaagactcgaaaacggcagatccgagcggctcactcgcgcttttgcaggagcttcacggaagatggacggctctgctccgcaccctgacggatcagcaatttaagcgcgaattttatcaccctgatacaaaggagatcattaccctggagaacgcgctcggcttgtatgtctggcactcacatcaccatatcgctcatattacggagctttccagacggatggggtggtcttaacgcttttgccggcggaaagccggaatactgatagcagcaatcaccagaagtgagatcacagcagccgctgcatataaatgatcatagccgctggcgacactcgcatgaatggcgtcgcttatcgcggttttgacttcaggaacgggaatgcgttcgatttgttcttgtaaagaagaaacatcagaactgtcgatctccggaatcatctgcgtcgccttttctgaatgtccgctgtccgataagcggctgttgatctcaccacctatttggtcaaacccggctgtgataaaacctgcataaagagtaggcgccaaggtcagtccaatttgccttactaatgaaagcgtgccaagagctgtacccttatttgtttttgccgcttctgatacaaggacgttcagcggagcgcctaacagaaaaccaaaaccgatcccagctgccatacttgcgatcacaaactcccatttttccgtcacccagagcggaaataaagcaaaccccgcacatgagatgattcccgaaagaataacggtttttacaggaccttttttgtcggtaagcgctccgccaagccaagcgccgattccggaagccaacgcaagcggtgtcatccaatagcctgcttttgcggcagggacacccaaatactgctcgacatatgacgggataaaaatgactgccgccaagagccccccggataacaaaccgatgataagcgtgcgctgaaacatatggtttcgcagcagagaatacgccaaaatgggatcgcctcctcgcatttcaactctcttttcatacgagataagcgctgcaaaacagagtatgccaaaaataatacatccataaacctccggattccccaagctgtgtaagagatttgccccgtcaaggttcgtcatgccgtacatcacggctaaaatcgacagggatagaaggaagatcccggccgtgtcgaggcgcttagcttcaggtgcttttgtttccgcgataaagtatgcgccgaaaacaaccaatagcacggcaatcggcaaattaatcaaaaacagccaatgccaagacccggtccaatcaagcagaaagcttccgatatttggcccgagcacagcggccatcccgttcattgcgccaagcagcccaagcgccttcccctgtttttcctttggaagggtcgcgagaatgtgagagctgccgatgatgaaaatcccgccgcctccaagcgcctgaatcagccgcgatatcagaaagagcgggaagctttggctcaaagcaacaagcaaagaaccaagtccgaacaggcaaacctcaatgagaaagagtttttttctgccgtagcggtcggaaagctttccgacgattggcacactgacgctaagaccgagcgtataaagggtaatgccccatgatccccaggaaggagaaacggcaaacgactcgtttatcgttgttaaagcagctgaaataattccgttatctagcgcagccataaatacaccaatcgtaaacaggctgatcgcccacttttggcctttctgctctgttaatgcttcagacatattcatcaaccccttttttttattcactcgaagtatattattcattttaaatgaactaaatgtcaaataaaaaaagcctgctcccgcagtttgcggatgacagacttacagatttattcttttttcgctttctctaatgctcttgaaaggatagacagcccttcggaaaccgcctgcttttcttcaggggacagcagctctaatgaacgcttcaatttcaggtggcctttttcatacaaaccccggaaaatctttttcgcattttctgtcaactgaacaactacagagcggcggtcctcttcagaatgtgagcgtttgacaaattctgatttttcaagccggtcaagcagcccagttgtattggacagggaagcccccattttttcagcaatgtcgctcactttcaatgttccatggttgtttaatagcatcagcaccttcatttgcggcatgctcatatccagcttcatccactcggacacatcaccgagcccggcggacgttaagactttcatatagagcacccatatctcccgttcctccgatgaaagaatgttttcgtttaatactgttgtatcgtgtaaattatattccatttcatcacttcctcatcattcactcctcttaccatattactcgatttacactcctgaaagaaagtgagcagaaaccacatgcgggactttgtccgaaaaataacggtagtgtataatgagttggagattattgggggagaggatcgaactagaatatgattggagagaccattgctgattaaaaagaatgctttatcaatattaaaaatcgtttttcctattgctgttttgctatttgttatttatcaatcgaaaaaagaactgacaaatctgtcattcaaacgtacgctcatggtcatcaacggactggaacgaacggacttattcatgcttgtgttgatcggcttgctggctgttgcggccatgtcgctgtatgattacgtcctgaaatactcactgcgcctatcgatcacaaacggaaaagtattcagggtttcctggatcgccaattcatttaataatgtgttgggattcggcggtttagccggagtcgggttaagaatgatgttctataaggagcatacgaaagaccataaggcactcgtgaaaggaatcgcctggctcacatcatctatgctgctcggattatctgttttcagcattttcgtcgctgcgagagtgctgccagtggatgaagtgattcatgaaaagccttggctatgggcggtcgttatcggttttgcgctgatattgccgctgtctttggcggtgtccaaaataaaagaccgcaaagctggggacgaagagaatgcggataaagtgaaaaatccgattttcgcatatattggagcttcagttgttgaatggctcatggccgggaccgtcatctattttgctttgttcgctatgggcattcatgcagatatcaggtatgtgttcggggtgttcgtcattgcggcgatcggaggaatgatcagcctcgtgccgggcggcttcggctcgtttgaccttttatttttgctggggatggagcagcttggctatcatcaagaggccatcgttacttctattgtgttgtacaggctcgcctactcatttatcccatttatcttgggactgttctttgccgccggcgacctgacggaaaatacaatgaagcggctcgaaacgaacccgcgcatcgcaccggcaattgagacgacaaacgttctgcttgttgttcagcgtgcggtattagtgagaattttgcaaggctcgctttcccttattgtgttcgtagcaggtctgattgtcttggcctcagtttccttgccgattgacaggctgacggttataccgcacattccgcgcccggcgcttttgctgttcaacggcctgtccttaagctcagcgctcattctgctgattttgccgatcgagctttataaacggacaaaacgttcctatacgatggccattacagcgcttgtcggcggctttgtgttcagctttttaaaagggcttaacatcagcgcgatattcgtactgccgatgattatcgtattgcttgtgctattgaaaaaacaatttgtccgcgaacaggcatcctatacactgggacaattgatattcgctgtggcgctgtttactgtggcgctctttaactacaatctgatcgcgggctttatttgggaccggatgaagaaggtgctgcgtcacgaatatttcgtccacagcacctcgcatattacacatgcaaccatcatggcgatcattattgtgccactgttcttcttgatatttacagtggtctatcataagagaacgaaaccgatcggagagaaagctgaccctgagcgtcttgctgcgtttcttaatgaaaaaggcggcaacgcgctgagccatctcggttttcttggagataagcggttttatttttccagcgatgggaatgcactgcttctgtttgggaaaatcgccagaaggctggtcgtgctcggcgatccgtctggccaaagagaatcattcccgcttgtgctggaagaatttctgaacgaagcgcatcagaagggattcagtgttttgttctatcaaattgaacgagaggacatggcgctgtatcacgattttggctacaacttctttaaattgggcgaggaagcatatgtagatttaaatacatttaccttgactgggaagaaaaaagccggccttcgggcaatcaataaccgctttgagcgggaggagtatactttccatgtggatcatcccccattttctgatgcgtttttggaggagctgaagcaaatctcagacgaatggctcggctcgaaaaaggagaagggattctcgctcggattttttgatccttcctatttacagaaagcgccgatcgcctatatgaaaaatgcagaaggagagatcgttgcattcgcaaatgtcatgccgatgtaccaggaaggagagatatcagttgatctgatgcgctatcgcggcgacgctccaaatggcattatggacgcattgtttatccgtatgtttttatgggcaaaggaagagggctgcacgtcatttaatatggggatggcacccttggccaatgtcggcactgcctttacatccttctggtccgaaaggtttgccgctgtcatttttaataatgtcagatacatgtacagcttcagcggcctaagagcctttaaagaaaaatacaaaccggagtggcgagggaaatacttggcgtatcggaaaaacagatctctttctgtcaccatgttcctcgttacacgtctgattggcaaaagcaaaaaagactccgtctaataagacggagtctttttttatttcgtttttaagaagtaggtttcaatatcatcaagcaggtagtttgcggctttaattccgcctgcggttgtccatacgacgtcatcgacttcatgtgcattacctgacttcacggccttcaggtttttccatagtgaactgcttgtccactgattggcccatttttcattttcttttgcattatcggctttataagtgaaataaaacagcacatcagcatccatatcaggaatagattctttactgtcggttgagaacgtaaattggtccttttgtttcttaaacagttccacttgtttttcagggcgtttgaagccaagctggtctaaaataatcccaggaaatgaatcggtataatagattcttgattcaccggataaaaagcgtacgactgaaacggttttgtttgtctggtcgcccagcttgttttttaaatcagaaacacgtttatcaaaatcggcaatgacttccttgcctttgtccgccttattcaccgcgttggcgtatagagtcaggttatccttccagttcccggccaaagattcagcaaaaacagtcggcgcaatcgcatttaactgatcataaattttttcctggcgcactttgtttccaataatcaaatcaggctttaattctgcgatggcttccacattcggttccgtttcaagaccgacgtttttaacacctttcatgtcatctttcagatagtcataccacgggtcgcccttccatgaccttacggctccgaccggcttaatgccaagcgctaagagcgcctctgttccttcattagttaaaacaacaatccgttttggattggcggggatgttgtctgatgtccccattgcatgtttgaccgttcttgttttgctgcttgacacctcgctgttgcttgaactttctgaactattacaggcagaaagtaccataacggccattaaaaatacgaatagcatgctgatatgctttttcatctttttcctcccaatattgaaattcattatcatttagatcataataagcagtgttaagagtgtcaatccctaattgaggattattctcaaaaacaaacattacatagtaaataactaggagaattagatcatgatctgcaaaaaggcatctttaaaatggattgtgttagtatgtctgattttcattttactggcggctgtctgcgcaagcgtcgtgtatggctatacaggtacgtcatggagacaggtctatcaggcgtttacttccttcaatggaacaaatgagcatgtcatcatcaaggatgtcaggcttccgcgcgctttggttgcgacagtcgtcggcgcctcgcttgcagccgcgggcgctctcatgcaggcgctcacaaaaaatccgcttgcgtcaccggggattttttgtgagcgccggtgcaggtttttttattgttgccggatcgttttttctgcatattcagtcacctcaggcattagtatggagctcgtttctgggggcagcatttaccgctgcgatcgtctatgcagcaggctcgcttggaagagaagggctgacgccaatcaaactgacgctggcgggagctgccatggcagccatgttttcttctctgacacaaggcttgctttctgtcaacgaactcgagcttgcccaggtgcttttttggctgactggctctgtgcagggccggagtctggatctgttgatgacgatgtttccatatgcagcggcagcgctggtaatctgcttctttctcggccaaaaaattaatctcctcgttatgggagaagatgtggcaaaaggactcggccaaaaaacgggcctgctgaaatttgtgatggcgctttgtgttgtcatgcttgcagggtccgctgtcgccattgccgggccgatttcttttattggcatcattattccgcattttgcccgctttgtcgttggtaatgattatcgctgggttctgccattttccgctgttttgggtgccattttgcttgtttgcgcggatatcggtgcgcgatatatcattatgcctcaggaagttcctgtcggggtcatgaccgccatcatcggaatgcctgtgtttgtgtacatcgcaagaaggggggcgaagctatgaaacttcgttttggcgttactgcggctgaaaagaaagcatggatcgtctttttggttttactagggttaacagctgctgtactcatcataagcgctggtctcggacaaaggtttattcctccctgggatgtagcaaaaacattctttggtgcaggttccaagctggatgaactgatgatcatgtcgttccgcatgccaagaattttgacggctttatgcgccggtgtctgcttggcagcggcaggcgcgatattgcaggggctcgtcagaaaccctctcgcatctccggatattatcggaataacaggaggagcggcggtagcggtcgtgcttttaatgatgttcttctcagaccgcagcagttcacttacgatcagtctgtcatggcttccagcagccgcatttatcggcgcatcggctgtcgggctcatcgtctatttactggcatacaaaaatggcgcctccacatttcggctggtgcttatcggaatcggattttcaatgtcggcgcaggcgatgactaccctgttgatgatcaaaggcccgatttaccgggcatcacaagccaatgtgtatatcactgggtcagtttatgggtcaaactggcagcatgtaaaaatagctattatcttatctgtcattctcttattcatttgttttgtcgcgctaaaaaatatgaatatacaggtgctgggtgaagatattgcggcgggtgcaggaagcgctgtgcagcgaaatcgttttttcttgctccttttgagtacggctcttactggatgtgcagtttcagttgccggcacaatcggttttgtcgggctgatggcgccccatattgcaagacggcttgtcggctcatcttatggcgccctgctcccagcgtcggcacttattggagctctgctcgttttaacagctgatatcgtcggcagaaccttatttgctccggtggaagtgccggccggcgtctttacagcggctatcggcgcaccttattttatttatttgctctataaaacaagaaattcttgatcgttacacccattttcttaaaaaagaaaatgggtttttttgataatgactgaagattcgtaattatttttgctatactgacagagacattgataaagaaagggcggcagatgaatgaaagaagcagaggtattaaaatatgaagcatttacaagcagtcccggcaaaggaaaccccgcaggcgtcgttttgcagggagacgattatacggaagacgagatgcagatcatagctgaacgtgccgggtattcagaaacctcctttatccgaaaaagcgagtcggccgatcttgaactccgttactttacccctggacacgaaatgaatttgtgcggtcatgcgacagttgcttctctttacgcattatgtgagaaaggaatgctggagagcggtaaaacgtacagcatccaaacgaaagcgggtatcctgcctgtgaagatttctgaaaaagatggccgcattcatatcacgcttgaacaggcctctccgcaattcaaaccatttacaggcgatcggaaaaaacttgcggacgcactgggtatcaccgatgaagattttcatgaagaccttccgattgtgtttggcagcactgggatatggacagccatcgttccgcttaaatcattggaggcttccaaaaaaatggtgccagataacaaacaatttccggaagtgttagttgatctgccaaaagcttcagtccatccgtttacctttgaaaccgtccatcccgacagcgacctgcacgggcgccacttttcatccccgtattcgggaacgattgaagaccccgtgaccggcacagcatccggcgtgatgggggcttatatgaaacattatggcaatgccgagcagcataaatttatcattgaacaagggcaggaaattggaaaagacggaaaagtggagatcgaaatgaacgaagccggcggccatgtgaaagtgaacatgacaggaacagccgtttactcagaaacccgtattcttaaaatctaatacggatgatggtttacaaaaagatgcactttccgttatcattatgaaatgataatcattttcaattgcataggaaggtgagacggtatgcctcaaaccgaacaaatacatcagcattcagtactgcgggacatcatacgcagcagaagatcgattcgaaagtttaaacaagagccagtaccttcagcagtcattcttgacatgcttgaaacggcaaaatatgcgccaaatcacagagtgacagagccatggagatttatttacgtttccagtgagacaggtaaagcgaacctcattaatacatttgcagcgttctctaagaaatccaagccggatatgacagaggaaaagcttcaaaatttcaaaaacacacttgggcgcgttccgggatttctcctcgtcgtgtttcaggaagatgaaaacgaaagagcgcgggacgacgattttgcggcaacaagctcgttgattcaaaatcttcagcttctcgcttgggaaaaaggaatcggcatggtttggaaaagcggaaaaatcctttatgacaaagaagtccatcaggcctttggtttacaggataatgagcgtttcgccgccatcatacaaacaggttatcctgacgaggcgccggaagtgaaaaaacgcacaccgatccgcgaacggtttactgaaatgtaaaaagccccttgtctcaaacggagacaaggggtttttcattaacgagatttctttttcgctctgttgtcggctgctttcgcacgctcttgcgcttcgcggtcatctgcatcagcaagctcggttgaatattcttcgtaaacgccgtcagtttccctttttaatgcatcgggaacttgtggaagcttttgtttgtttttatcacggtttttgtggatatgatttctgcccatatcaaattccccctaaaaagtgatatcaaacaaatatagtatttggttttaaggggctatgtattcctacttccgcttagcagctttttccgcttttttaaattcgcctgaataaagaacttcctgcatttttttcaggttggcgccttgctggtgcttctccctctttttttccataaaaaggacctccttcaaccatgttattcttaaggttgacgcttcctgctgtttttatacagtctttcggtccgctatcagctgtgagagtgcaaattcaagatccgaatatgtaaaacgaaatccagaggttatcgcttttttcggaagagcgcgctgtcctttcacaatcaaaagactcatttcacccaatgcttttgataaaaagaattccgggacggggagccagtgcgggcggtgcttcacccgtgcaatcgtttttccgaattgcttcatgtccacaggattgggcgcggtgacattcattgggcctgagatgccggcgttttccaccgcatatcggatcatctgggccgcatcctcgacatgaatccatgacagccactgccttcccgttccgatcgttccgccggccagaaacttataggggagaatcatgagcgggagagcgcctttttctccaagcatcacgccaaatctcgcataaaccgtcctgatgcccatcgcctcaatatgctgtccttccttttcccacaggtgtgcagtatggctgagaaaatcctcatctgacgttgcagaatcctctgtgaaggttttctcaagactagtgccgtaaatacccacggcactggcttggatcaatgtgttcggcttctccttctgtttctgaataagccgctgcacttcacgcgtcgcattgatacggctggagagaatgtgctgctttgttttatttgtccagcggccaaaaatcgattttcccgcaaggtttatccagacatcaatatgaggaagttcctgctccggggcggctccttccgtcagccattggacatatgtcatatttttttgttcagtttcccgtgcgtttcttgataaaatataaacatggtgtccctggcgggtaagaacgcctgtcagatgctggccgagaaaaccggttccgcccgtcattgcgatattcatgaacatctctcctcatcgttctaataaatatactttacctcattttaataaaagaaaacgcgtttcaggcctgagaagggagattaagatgccgtttattacaaaaatatcaacgcaaaaaaagaatacggaacgcttcaatatttttctggatgataaatacgccttcagcgtggacgcggatgtgctcgtgaaatttgagctcaagaagggaaaagaactcgatgatcttgacatcattgagattcaatacggcgatgaagtgaagaaaggcttcaaccgtgcgcttgactttttatcctatcgaatgcggtcgacgaaagaggtcgaggaccacttaaagaaaaaagaaacctcgccccccgtcattgcggaagtcatccataggcttaacgattacaagtacttaaacgaccaggaatttgccgcagcctatgtcagcactcacaaaaaaacaaacggaaaaggccctgatgttttgttcagagagctaagagcgaagggaattgatgacgatacaattaaggaggcgctaagttccttttcctttgaagatcagacaagagaagcggtcaagcatgttgaaaagcttctcaaaaaagataaaaagctttcgacgaaagaactcaaacagcgcgcccagctgcagcttcagcgcaagggcttctcatttgatgttatcagcgcggcgatggatcagattgaatatgaaaatgatgaagacacagagaaagaagcgctgcgccttcacgcggaaaaagcgtttagaaaataccgctatgacggctcatatgaaagcgccatgaaggtcaaacaatttttattccgcaaaggattctcactcgatttaatcgagcaattactgcaggaagaggagtactgaaatggagaaacgatacagtcaaatgacaccgcatgaactcaataccgaaatcgcattactttctgaaaaagcaagaaaagccgaacagcatggaatcataaacgaactggcagtgctcgaacggaaaattacgatggcaaaagcatatttgctgaacccggaagattactcaccgggagaaacatatcgtgtggaaaacactgaggacgagtttaccatcagttatttaaatggcgttttcgcatggggatacaggacctcttcccctcagcaagaggaagcgctgccaatctcagtattgcaagaaaaagaataaagcgtaacaggaggctgatgatcagcctctttttgtttgcagcacatttacacgaattcttaaagaaaaaatcattgaattcacttgaaaaatcttttaagatgaaactcgttgttttttaaaatcaaaggaggcgatgacgttgagtatcaaaaacccatctgtaaaatttattatatttgttcttatgatttgtacattttcaatcggctatacagaatacgcggtgatgggtattttgacgtcgattgccaatgactttcatatacaggtttcatccgcagggcttcttgtcacggcttatgcggcaagcgtttgtttgacagggccgctcgtcaccatcatttccgtcaagcttccgagaaagcctgtgcttcttgggctgatggcgatatttatcctttccaacctgatgagcgcactggcgccgaattttgcggtattggccatttcaagaattttatctgcgtccattcacggcgctttcttcgcgattgccatggtattcgcaagtgaaatggttccgccggaaaagcgtgctgcagctgctgcttcaatgaacggcggactgacagtggctctaatgcttggtgttccattcggctcttatctcggagatgtcctgaattggagagcggtgttttccatcattacggcacttggtgtcatcggatttttaggccttatggctgccgtgccgaacagaaaaccaaaagtgatcccaatgcttatgaatgagtggggtgtttttaaacacaaacaagtgctgttttccttcgcgattaccattttaggctattccggtgtctttatcgcctacacctttatcgaacccattttgaggcattcagccggattcagcacggttggcattacaggtgctctctttgcgtatggattgggaggcgttgccgggaatttctttgctggaaaagtaccgctacctttgctgactcggacgatgatcggcgtaatgatcggtttaatcggtgttctggctgtatttccttacatcgccatttacccggctgcagccattgtggcaacgttcctattcggggcatgcgcattcggcacgccgcctcttttgcaaacaaaggtcatttcatcatctgagggcggcacgaccattgccgcagctgtcagcgtatcagcatttaaccttgccaatgcccttggtgcatggatcggcggaatgattttaaacggaacaggctcttattcctggctgtttgcaggaggtgcgcttatgactgcatgcggacttgtgctttctaccttcgcacacttatcagaaaagaagagcgtctacgaatatcaagtcaataaagggtaaaaacagctgcagtgtatgcagctgttcttctttaccgtttgcctgaggctctcattctttcttgaggatgctgattgattgatccgtcagcacgctttgaagcatagtcgtcctttgctctcggttcaccctgaaatttgttttcgttttcgtaaggaaatcctttttctttatttcggaccatgtcatatccccctaggttcgagatcaaaaagttgcgtctttccagatgaagacgtaaggttagtatatggagaacaccacgtaataaagcgttatttttttcctgaagaaaggagactgcacacatgaatatgtacattgagaaactgactaatctgcttctggaaaagaacgagatgatcagctatatacaggcaaaaacgtgggtggaattgttatggagcgatttcgaagcaacctatgcaaaagccggacacgcctatcaaggtgaaaaaatgactgaaaaaatcgtcacacaatggattgaaaactatggtggccagctccacctttttcaaagctcccgtaacgacgtgaatgattacttaaatcaaagcaaaggccttttgcactaaaaacctgccgttaacgaccggcaggttttttcattttcttaaaattaccttaacaggaagaaatcataaacaaaacatgtttcaccagcctgtcaatcagggaataccacttatatcttgtcaaaatgcgaggaggagctttatatgaaaaagaaacaagtaatgctcgctttaacagctgccgcaggactgggtttgacagcacttcattccgctcccgcagcaaaagctgcgccccttcacgacatatctgtcagcatgccatcatccgattcttacatcataaaaacaggaaagctgaatgtccggactgagccaaatcataaaggtgacattctcggcactgtatcatcagaacaaaaagtaaaagtctatggatttgtaaatgccgattgggctcaaattcatttcaaaggaaaaaaagcgtatatttcaacccactttttaatgaaaaccgcaagccaagcgaaaacaatgaaacagacagccttctatgcaccgacgcccgaaaatggaaaagctaaacagctctcatctggaacagaggtgacaatacttgggtggggattcagtgaaaacggcggatttgacttcacttgggcgttcgtggattatggcggagttaaaggctatattcacacaaaggatttacaaatgcgataaaaaggcaggccgaggcttgtctttttgcctatgcatgaaacatttctcctttctgcacgtaacaatgagaaaggagatgatgatatgacgggtttagtcggcggagggcttatgatcattgcgggcatactgatcaaactgtttcctcccaaatcgatcaacagtgtgtacggatacagaacgagacgctcaatgtcagatcaaagattatggaatgaagcgaaccgttacagtgcatcattaatgatcctgtcaggcttggtgattgcgggaatgggtttgctgctgggatcaaacttgtttattcttcagcttatcctgctgattgccgcctgtgtcataacatttatgctaacggagaaaaggctgaaaatcatgacgcacagtcaaggaggagatagaagtggacggagttaaatgccagtttgtcaatacgaacggaatcacgctccacgttgcagccgcaggaccggaagacggcccgttaattgtcctgctccatggatttcctgagttttggtacggctggaaaaatcaaatcaaaccgcttgttgatgcgggttaccgggtcattgctcctgatcagcggggctacaatctcagtgacaaaccggaaggaattgattcgtatcggattgatacattaagagatgatatcatcgggcttattacgcaattcactgatgaaaaagcaattgtcatcggtcatgactggggaggggctgtcgcatggcatttggcttccacacgcccggaatatcttgaaaaactgatcgcgatcaatatcccgcacccgcacgtcatgaaaaccgtaacgccgctttatccgccgcaatggctgaaaagctcgtatatcgcatacttccagctccccgatataccggaggcatcactaagggaaaatgattatgaaacattagacaaagcgattggattatccgaccgtcccgcgctttttacatccgaggatgtcagcaggtacaaagaagcgtggaaacagccgggcgcgctgacagctatgctgaactggtacagagccctcagaaaaggaagcttggcagagaaaccctcttacgaaacagtaccttaccgaatgatctggggaatggaagaccgctttttgagcagaaagcttgctaaagagacggaaaggcattgcccgaatggacatctcatctttgttgatgaagcttcccattggattaaccacgagaagccagccatcgtcaatcagctgattttggaatatcttaagaaccaataagctaaaatttctctccatccgtctgtcataatggcagactttttctgtgcgtttttttcatagtctgttttaaacatgacaaaataaaattaaaaatcatgaatgtcaccataaaattgtaacaaaaaacaggtttaaacgactttaaaaaaaggaatagccttactgaagatttgtgtaaaactcccctaaggcaatacttaaaaagaataataaaaagaaggtgccttaatgaagcaaggattaatctcgattattatcccgtcttacaatgaagggtataatgtcaaactcattcatgaatctttaaaaaaggaatttaaaaacattcattatgactatgaaatattcttcataaacgacggaagtgttgatgacacgcttcagcagatcaaagacttggcagcgacgtgcagccgggtaaaatatatatctttttctcgaaactttggaaaagaagccgcaattttggcgggctttgaacatgttcagggcgaggcggttattgtcatggatgccgatctgcagcatccgacatatttgctgaaggaatttatcaaaggctacgaagaagggtatgaccaagtcattgcccaaaggaacagaaaaggggacagctttgtccgctcactcttatcatctatgtattacaagttcattaataaagcggtggaagtcgatttgcgtgacggtgtcggtgacttcagattgttaagccgccaagctgtgaatgcacttttgaagctgagcgaaggaaaccgcttctcaaaaggccttttttgctggattggctttgatcagaaaattgtattttatgaaaatgtcgaacgaaaaaacggcacctccaaatggtcgttcagcagtctgtttaactacggaatggacggcgtcgtttcatttaatcataagccgctgagattatgtttttatacaggcattttcatcctgctgctttccatcatttatatcattgccacattcgttaaaattctgactaacggtatttctgtgcctgggtatttcaccattatctcagcagtgttatttctcggcggagtacagctgttaagccttggaattataggtgaatatatcggccgaatctattatgaaacaaaaaaacgcccgcattatttgatcaaagaagcgaatatcccgaacaaagacctgcctgaaacgaacgaattaaaaagcatgcggcgtctgacaaaaatgcactgaaaataccaagcgccattggcagtgctttttttgcgtgtctattatcttaaaagcaagactggagaatttatatgaaaagaaaacatatcatgatctatgcggccagtttgctggtgtccgttctggcacacgctttttttgtgaaagaatgggcggaaggcaggtatatgacaggtccgggtgacgggcttgcgcaaatgatcgtatttaaaaaattattatttgaccaatatacacacgggaattttttctacaattattcattcggacttggcggcggcacattcagtcagctcggctattatttttctgcttcttttctttttcttgctgtgtctgccgctgtttggctgcttcaagccgtccagctgatcggagaagcggatacgcttttttgggcagagtcagctgtttttatcagtattttcaaattgagcttgatcatctttacgtccgcttctgtttttcattatcttctcaagcacagggcggcatcgttcacgggagccgtgttatacggcgtctcaattatttatttccgtcacgaagcgtattgggaatttttcaccgatacaatggtttggcttccgctgcttgttttcggtgcagaaaaaattattagagagcggcgtccggcgtggtttatcgttgcgtgttcgctgacgttaatcaacaatttttactttgcatacataaaccttatattcatcggaatctatttgctgttcagatggctgatccgtttggaaccacatgaagagaaaagatggattcaaatcagattatttctcgtttcaggcttcatttcttttggcatcagtgcggaggcgtttgtgcccgtagtatacggttttttaaacaacctgcgccctccatacagccagaaaatagagtggctcaatttcgatgataatatcttattttcgagccggatcatcattgtgccggccgcttttctgctgtttttgtttattatttctttttacaaaaaccgtgtgtttcgtctctttgccggattgagcctgctgtttattctttttcatttcagtccgtatgcggcaagcgtctttaacggtttttccgccccgcaaaaccggtttgaatatgttctggcctttaccattgcgggagcagctgcggctggtttgtcacagctgtctgatttgaaacggaaagaactgctcccggccgcagctgtcgtcctgcttctttacttgtatcatattcaaaggtataagctcgatatatggaagcctgcgaatgaaagtattctattgctcttactcatgacaatcgcagccttgtttgctgcagcttttgcgaaaaaacgggcaaaaatggctgtgtacggtataatcattctttcttcgctgtttgtcgccaactcctatcaaaaatacgcgctctcagaaggcggcgatttggacagtgtgacaaaagaatatcttacaagtgaggaatacagagggcgggaatcatctgagctcatcagacgtttacagaaggaaaacgatgatccgctcatgagaatcgactggatgaacggggtccgcaataatacgccaatcatttacgggtttaatggcttcagcgcctattccagcattttaaacaaagatctgctggccttctattggaatgatttaagcatcgatatgggcagggaaagcgtcagccgttacgcgtcattgggagacagggcgaatttatacagcctgctttacggcaaatattatatgaccgaaaaaacaaacgaagccagcgtcccgtacggcttcaaaaagcatttagaaacagagcattatgcagtttatgagaatcagtacatgcttccattcgtcaaaacagcggatgccatatacagcgaaagtgagctggaccgattgcccgctcttgcgaaagaacaggcgatgctgaaaggaatcatattaaaagatccatcaggaaaaacggagcagacaccaaaaccgtccaatttgatcaccaagtcggacatcactgcaaaacaagcccagtatcaaaacgggctgctaaccgtaactggagaaaacggaggagagctgatcatcaccccgaaacagccgtcatccgctccgggagactactatgtcagcttttatttgaaaagcaaagcaaaagacaaaggatttacgttaaaggtaaatgattatgtcacaacaaggaaatcgaacaaatcgatatataaaaccggagtaaataatataacggtaagagtgcctaaatcacgccatatctcaatcaatcttccgaaaggaacctatgagctgagaaacatagcgctctatgaagaaaattaccaaacgctgaaaaacgctgtaatgcaaaataaaacagagaaagcagacaaactgaattggaacaaaaatcgactgacctttgcatatcatctgtcaaaagaccagtacatcatgcttccgatcccatatgaaaaaggctgggagctgaagatcaacggaaaaacacagaagatcgaaaaagcggattatgcttttataggcttcaaggcgcaaaagggagacaatcacattgagctgacttactatccgccatacttcaaaatatcggcgatcatatctctcgtcagtctgctgcttgctgttttttatataagacgtaaaaagcccggctctatatagagccgagctttaattttttctgtagtttttcttcgctgaatatccatcccgtataggatgaacgaattgtgagatcatggccgatatgaacaattgcgacaaacggataatggcctttgctccgataacgcaggtcgataaatctcacctcataatgatctttaaacgtatccacttcccaccggtaaaccggagaaaaggacagaaacgccgcgatgttatcatcctgctttgccgcatgcattacatcggtttcaggaacaggcacccgattaaatgtatccagaatcacgacatgtccttccatgcttcttcctacatagaaagcatgtgctgtcgtcactgcgattcgccattgcctgaatttcatcgttggagaaataataatgctttcgatctcatcatgaatcatctcatgaagcttccgtttaattctcagctgcatgatcaggcgcaccaagtaatagcctgccaatatgatatataagctgagaaacgtgatgccgggactcccgcctgcataccaaatcgcgatagctgctagatggctgataaaaataaacggatcaaacgtattaatcagcccgagcgcaacccattttttcgaaaacggacgaatggcttgtgttccataggcgttgaatatatcaacaaagacatgcagaacgactgccagcagtgtccacagccacaggtgcagaaaatcggcctgaggataaaataaatacagaatcgccgggatgatgacagaccaaaacaaaacggcgggaattgaatgggtaaatcctctgtgattccttatataaacagcattgtttttaagctttaacacagtatcaatatccggagcctgagagcccgcaagcgttgcgatcataacagcgtgagccattgccggatctgatccgacaacaggatcaagcgtcgcaataccgcccagtgcgatgcccataacgacatgtgtgcccgtatccataggtgacctccttgcaggatgatcctgcacattcactttgtaagaaattccccattttcatatacccaatttttaaactgattcaatcgttctcatatgtttccgctttttctttattactatttaatgtaacatattatcgtactgtgcccttagtgtacaacaaaaaacagtctaaagaaaagcggggcgcgaaagactggggagaaacacatatgaacgtacttgaagacaaattaaaacaaaaagacatacagcaatttcgcgatgatttaatctcatggtttgaacgagagcagcgcgttctgccgtggagagaggaccaagatccttataaggtatgggtatctgaagtgatgctgcagcaaacgagagtagagacagtgattccttactttctgcggtttgtggaacaattcccgacagtggaagcgctcgctgatgctgatgaagaaaaggtgctgaaagcatgggaagggctcggctattattcgcgagtcagaaacttgcaaagcgcggtaaaagaagtgaaacaggaatacggcggcattgtccctccagacgagaaagattttggcgggttaaaaggcgtcggcccttatacaaagggagcggtgctcagcattgcctacaataaacccattcccgcggttgacggaaatgtgatgcgtgtcatgtccagaattctttctatttgggatgatattgccaaaccaaaaacaagaacgatctttgaagacgccatacgagcttttatttccaaagaaaaaccatctgaatttaatcagggcttgatggagcttggagccttgatttgcacgccaaaatcaccctcatgcctgctatgcccggttcagcagcattgctcagcatttgaagaaggcactgaacgggagcttccggtaaaaagcaaaaagaaaaagcccgggatcaaaaccatggccgcgatcgtactgactgatgaagacggacaagtgtatatccacaaacggccgtctaaaggtttgctcgccaacctgtgggaattccctaatcttgaaacacaaaaagggatcaaaactgagcgtgaacagctcattgctttcttagaaaacgaatatggcatacaagctgatatcagtgatctgcaaggtgtagtcgagcatgttttcacccacctggtatggaatatttcagtgtttttcggtaaagtaaaacaagtgtcggataccagcgagctgaaaaaagtaacgaaagaagagctcgaacaatttgcgttcccggtgtcacatcaaaaaatctggaagatggcagtagaagcagccgccatctcggctgctccgtaaaccattcttaatcgtaagagacgcgcgtgccgtggctgtagtccgcttcattgcgcttcattccgccgcgcgcttcaatttcttgcgttaattcccggtattttgattggccttcttcgttcaaataaggcataatttgctgaaaggcatgatgaaaataagcgagttcactgttcttccaatcttttttggaaaccatgttcaattcgctcatatcacgtccgacatacataacagaagaccccctttaaagttcttgccattattgtttgtggaaataaaagaactatacgctacaaggagatgaggaaaaatggaacaaaataaatgtgcactcgtaacaggaagcagccgcggtgtcggaaaagcggccgcgatcagacttgctgagaacggctataacatcgtcattaactatgcacgcagcaaaaaagcagcattagaaacagcggaagaaattgaaaagcttggcgttaaagtgcttgtcgtaaaagcaaacgtaggacagcctgcaaaaatcaaagaaatgtttcagcaaattgatgaaacgttcggcagacttgatgtttttgtcaataatgccgcttcaggagtactaagacctgtcatggaattagaagaaacacactgggactggacgatgaacattaatgcgaaagcattgcttttctgcgctcaggaagctgccaagctaatggagaagaacggaggcgggcatattgtcagcatcagttcattaggctctatccgctatcttgaaaactacaccacggtcggtgtatcaaaagcagcgttagaggctttaacccgttatcttgccgttgagctttcaccaaaacaaattatcgtcaatgctgtttcaggcggagcgatcgacacagatgcgctgaaacacttcccgaatagagaagatctgcttgaggatgcgcgccaaaacacgccggcgggacgcatggtcgaaattaaagacatggttgatactgttgagtttctagtgtcttccaaggctgacatgatccgcggacagacaattatcgttgacggcggacgctcactgctcgtttaaaaatttttaaaaaagaggaatagctatacgatcacctgcacattctaatgaccgtggaggtgataacaatggctaactcaaataacttcagcaaaacaaacgctcaacaagttagaaaacaaaaccaacaatcagctgctggtcaaggtcaatttggcactgaatttgctagcgaaacaaacgctcagcaagtcagaaaacaaaaccagcaatcagctggacaacaaggtcaattcggcactgaattcgctagtgaaactgacgcacagcaggtaagacagcaaaaccaatctgctgaacaaaacaaacaacaaaacagctaatcactgaaacagaaaaaagcacttcatcttcgggtggaagtgcttttttctgtttgaaaaacgacaaaacttgtggaaggtctacagaatgagtcaaagggtttgctttacggagatcgaaatgattaaaggaggaaatgtttatactttcatcaggctgaaggaggaaccgatgaccgaatttgaaaagctggtaagtgaacagatgaaaacgatggataagcttctcgatctccaatcagagctcgaccgctgcaaacaaattgaggcggaactccggcatttggaaagggatgcaaggctgcgtgggattcaggctgaaattgcggtaaaacggaaacaccttgccgatatacaggatatgtttcaaaagcagacagagcaggtcattcgttcatatcgcagctcagaaaagccgtcttcctttgtgtagtgcaggaatgtgccattccccggccggaatggctcttttattttcatttttcaatttgtaacgttataataggtaaaagacgttgtcggtaagcaaatttggacatactaactgtagggctttatagaaagtaggggagaaatatgggctatcccaaggaaggagaaaccattcaaattcacagctataagcacaacgggctgattcatagaatttggaatgagacaacaatcttaaaaagtacagaaatgtgtgtcatcggagccaatgaccggacgatggtaaccgaatcagacggccggacatggataaccagagagcccgcaatctgttattttcacgcaagacaatggtttaatgtcatcgggatgctgagggaagacggggttcattattattgcaacatcagttctccgtttgcctatgatggcgaagcaattaaatatattgattatgacttagatgttaaggtttttcctgacatgacctacaatattctcgatgaagacgaatatgatgatcatcggaaagccatgaattatccaaaagaaatcgacagtattttaagagactacttaaatacgctgctccattggattcaccagcgtcagggaccgtttgcgcccgagtttgtcgatatgtggtatgaacggtatttgcgctatacaaaataatggttacgtaaaaaacctgttgcggggtacaacaggtttttcacatgggctcacacacatcatgataaagagagagggggaatcaacgtgggggttatgaaacgctacatgcaattcgtcaaaccttataagaagcaaattttcgttacagtgttaatcgggatcgtaaaattctccattccgcttgctctcccattgcttctgaagtacgtagttgacgacattattcaaggaggcggcacggccagtgacaaaaccacgtcattgttcacgattatggcgatcatgttcgccttatttttaattttgcgcccgcctgttgaatattaccggcaatattttgcccagtggactgccagcaaggtgctttatgatataagagctaagctgtttgaccatatacaaaaactgagccttcgtttttacgcgaatacaagaacaggggaagtcatttcccgagtgattaatgatgtagaacaaacaaaggatttcgtcatcacagggctgatgaatatatggctcgatatgctgacgattttgattgtaatctctatcatgctcacactggacgttaaattaacgctgatctctatcgttttattcccattatacggaatatcagtgaagtatttttacggccgtttacgaaagctgacaagggagcgctcacaggctcttgctcaagtgcaggggcatttgcacgaacgaattcaaggcatgcctgtcatcagaagctttgcgatagaagatcatgaacaggctcaatttaatgagaaaaacggtcatttcttagataaagccatccgccacacgaattggaacgccaaaacctttgcggtcgttaataccattacagatttggcgccgctcatcgtcatagcgtgcgccgggtattttgtcattaatggaccgctgacagtcggaacaatggtcgcgtttgtcggatatattgacagaatgtacaaccctgttagaaggctgatcaattcctctacaactttgacacagtcaatcgcatcaatggacagggtgtttgaatttattgacgagccctatgaactcactgacaaaccaaatgcgataaaggccgatcagattcgcggaggagtggagtttcaaaacgtttcgtttcaatatgagaaggacaaagaaaatattcttcatgatgtatccttaaaagtaaatagaggagaaactgtagctctcgtcggcatgagcggaggaggaaaatcaacgctcgtcagcctgatcccaagattttatgatgtaacaagcggcagactgctgattgatgggacggatattcgcgattatgaagcaagaagccttcgcaaccaggttggtatggtgcttcaagatacctttttatttagtgaaacgattcgggaaaatatcgcgatcggcaagcctgatgccacacttgaagagataatcgaagccgccaaagctgcaaatgcccatgaatttatcatgagttttccagaaggatatgagacccgggtgggggaacgaggcgttaagctttcaggcggacaaaagcagcggatctcaattgcgcgggtattcctgaaaaatccgccgctcctcattttagatgaagctacatcagctctggatttggaaagtgagcattacattcaagaagcgatggacaaactggcgaaggatagaacaacttttgttgtcgcccaccgtttatcgacaatcacccatgcggataagattgttgtcatggaaaacggcacaatcattgaaatcggaacccatgatgaactcatggactatgagagccagtacaagcacttatttaccattcaaaatttgaactaaaacatcaatcttatatccttttaacgaaggatataagatttttttgtatataaaaaaacccggctgtttaaccgggttactcttctgtttctatttcgcagtctttcggatgatacgtttgaaaacttgtgataagtgtttctaaatgttcaagctgctcgcgatattccacggcgcttgccataatattgagcatgttgtaatcaataagctcctcatccgtattctgctgattttttaaaaatgactttgttaaaagctgcttataccggatgccttcttcaaccgcgtcatcatgcggcttgatttttccgacaaacctcatcaaaatccgttcgtgccagtaaagcaggtaatcaagttcttcagtcaatgtttcctgaaactcttccggcatatgatagatctcgttttccagacgatgcagcttcttcaatgtatcaagcgcccgatttgcagtaataatggcctgtctgaacaggacaagctttcttgatttcacataagtggttttcttaaagtaacttctttcttctttatatagaagatatgtctgatcaagcttgatcattttttctttcagtttttcaatatcctctttcaaaatcgaatgctctgtcgactgccgcatggacaatctgatccacttcataatttcttcggtgttttcgacggtattatgaatcagctttgtttcgtacttaggaggcaaaaacacaaggttgacgataaaggaagaaagcacccctaagatgactgtgcttgttctgatcagcgcgaacattaaaaagtcgtcaccggcagattctaatatcgcaatgactgttacaagagcaattgaaattgtatgttcaattttaagtttcagcatgattgtaatgacaataactgctgttaacccgatcataatcgggctgggtccgaaaataaggccgaacactgtggcaatcacagctccgatgatatttgcttgaacctggtcaataataatgagaaaagagcggtaaatcgacggctggatcgcaaatatcgctgcaattccagcgaaaatcggcgcgggaagcccgatccacgaagccaaataaagggcaagtgtaatcgcaatcccggttttgaaaatgcgggcaccaagtttcattggtttgtgcgtgcattcctttctatagtaaattgtgtgacatagcaaatgggctaatccttaaaattcccggttagtttatttgctaaacaattaagtaatatacagggatcgatacaaatattcaagctatttttctagaaaaagaccaaaatcttacacgttgtttgattccataaaaaaaacaggagctcaaagctcctgttcaaggtatttgattctagttttttagatgtttaaatgcatcctcgaccgctgtaagcgtgtctttaatatcctgctctgtatgtgctgtggtaataaaccaagcttcatacttagaaggtgctaaattaattccgcgttccagcatcagcttgaaaaacgtagcgaatgtttctccgtcactccgttcagcctgctcgtaattttccactttctcatcagagaagtataccgtgagcgcaccttttaaccggttgaccgtaatggtgatgccgtgtgtttctgcgtgcttcaaaatgccttcctcaagcatagcgccaaggtgatcaagcttttcatacacgcctttttctttgagcacttccagacaagcgatgcctgataggatggaagcggggttccctgccattgttcctgcctgataagcaggccctagcggagctacctgctccatgatttcttgtttgccgccataggccccaatcggaagtccgccgccgataattttcccgagtgctgttaaatctggtttcacctgtaagagatcctgcgcgccgccatacataaagcggaaagccgtaatgacttcatcgtaaataacgagagcccctgcattatgtgttaattcatttacttgttctaagaagccctctttcggctccacgataccgaagttgccgacaatcggttcaacgagaaccgccgcgatttcactgccccatttttcaagagctgctttatagctatcgatatcattaaatggtactgtgatcacttcgtttgcaatgcttttcggtacaccggctgagtctggtgtgccaagagtagacgggccggagcctgcggcgacaagcacaaggtccgaatgcccgtgataacagcccgcaaatttaatgatttttgtccggcctgtatatgcgcgagccacgcggatggtcgtcataacggcttctgtacccgaattgacgaatcttactttgtccatagcgggaatggcttctttgagcatctttgcaaatgtaacctcgtgtttcgttggtgttccatacaatacaccgttctctgccgcttttttaatcgcttctgtaatatgcgggtgggcatgtcctgtaataatcggaccgtacgccgctaaataatcgatgtatttgttgccgtccacatcccaaaaataagcgccgcttgctttctccattgcaacaggagaaccgccgccgactgctttatatgatctagacgggctgtttacaccgccgacaatgtgctgtaatgcctcattgtgaagttcaattgattttgtatgcaagaataaaaacctcctatatctccatgcgtcctttctattgtagcatgcttccgaacaagaacaatggcttcgggcttcagattcagctgagatggttgtaatctggacaagaattggatacgcttaataaaaaaacatccggaggtaacgtaatgactatagaaatcggacaaaaagcgcctgatcttgagttaaaaggtgatcatggggaaacagtaaaattatcggattataaaggaaagtacatcgtgctttatttttatccaaaggacatgacacccggatgtacaactgaagcatgcgattttcgggacagtcacgaaagcttcgccgaactggatgccgtcattatcggcgtcagcccggacagccaggaaaaacacggaaaatttaaagagaagcataaccttccatttctgcttcttgttgatgacgagcataagctggcggaagcatttgatgtgtggaagctgaagaaaaacttcggaaaagagtatatgggaatcgagcgttccacttttttaattgataaacaaggccggctcattaaagaatggagaaaagtaaaagtaaaggaccatgtagccgaagcgcttcaaaccctcaaagatatgtcggaaaagtaaatctctatgagcctatgcttacttttaccctgatatcaattgacaaattatcgtagaaagagttacactaattataaacattacaatgtaagaattttttttagaagagaggtgcatgacggatggctgcacatgaactaaaagaagccttagaaacgttgaaggaaaccggagttcgcattactcctcaacgtcatgcgattctggaatatctcgttaactctatggctcatccaacagcggacgatatatataaagctctggaagggaaatttcctaacatgagcgtagcgacggtatataacaatttgcgtgtgttccgggaatcaggtttggtaaaagagctcacatacggtgatgcttccagcagattcgattttgtcacatccgatcactatcacgcgatttgcgaaaactgcggtaaaattgtggacttccactacccgggccttgatgaagtggagcagctcgctgcccacgtcacgggcttcaaggtaagccaccaccgtttagaaatttacggcgtctgccaagagtgttcgaaaaaagaaaatcattaaaaataagctgaccgcacgaaacggtcagcttattttatttcgacattttctttttattataagactcatcaaattcttttccttctaatcccttatctaaagtcagcggctctcggcaatgcatgcacatatcgactcttcctaaaacctttgtctctttatcacagcctggacaaatgacgcgaaccgctttagtcgaaagcattccgatccaaaagtaaactaccgtgctgagaccgatggataaaagcccaagtatcataaacaaactagaaagcaaaactgactctttgaaaaagatcccgatgtacataatgataaacccaacgaaaaccaaacttaacgcaaatgttctgattttattaattttgctggagtatttcgccatgtccatccccctctgttttaactatagcacaaacccgatgggattttcttcatgttttcggttgaactggaatttacatatggagagttactgtgaaattgtttataatagttcaatgtgtttagaaaaaaggaatttcgttttaaccatagaattgaatcaaatagagaataaaaaaatttgaacaattgcattggaggaatagtgatggaaaatcttctccgtccaatttaccaagaaagagcaagtcaccccaatacattggctgtcattatgattgagagaagaaacaaaacatcttccttaacagataactttgatgcagctttgctggtgattgtaaaggatgctgatgagccagtttttataaagcattatgaatttgatcatcaaacagcttctttgcatgtggtaacagattctcagattcaagaatggattttgcttggaacaaatagaagaatcatagattggattgtaaatggcagagtcttgtttgaccgtaatgaatacgtagttgaactgattgacaggctgaatacatttccgtttgccgaacgtaaactgaagatcggactcgaatacggcaaattaatcagaaggtatgttgaagggaaagctttttttgaagccaatcaatttttagatgcctacaatgccgttgttcatgcgctgcatcatttagcacgtattgaagtaatcgacagaggattccatcccgaaaccacggtgtggagccaagtgcgccagatggagccccaagtgtacaaattatattccgagctgattgaaagtcatgagagcctggaaaaaagacttgaattattattcttagcaaatgattttctcatccattccaaagccgagatcggttcggcgcatcttttcgaagtaatgaaagaaaaagacatttggcaattcggtgagcttcttcaacatcatgacctaaagcactttacccaagatcttggcgttatgcttgattacttgacggaaaagggacttatcaacgtctgccagatagaaacgaaaggacaggctgtctatcaccgaggatattcttttaaaaaaggtgttgactctgattcttgaccgtgttatattattaaacgtcgctgatgcgcttctgagaaaacaagctcacagcggcgggaaaataaatcaaaaaaacatttgacaaaagaaagtcaaaatgttatattaataaagtcgcttcaacaagaagtgaaaatgatctttgaaaactaaacaagacaaaacgtacctgttaattcagtttttaaaaaatcgcacagcgatgtgcgtagtcagtcaaactagggcctgcacgacgcaggtcacacaggtgtcgccgcaggatgcggtgaacttaacctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggatattatacggaatataagaccttgggtcttataaacagaacgttccctgtcttgtttagttttgaaggatcattccttcgaaacgtgttctttgaaaactagataacagtagacatcacattcaattagtaacacaagatatcacatagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccgctcgtaatggagtggtatccatatctgaattcataggatatgagaaggcagacccggggaactgaaacatctaagtacccggaggaagagaaagcaaatgcgattccctgagtagcggcgagcgaaacgggattagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagccagaccggaaggactggtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccatatttttgaatgatgtcacacctgttatctagttttgagagaataagtttttcaaaaaaacacttgattttctcaagaatacatagtataatgttaaatgtcactgaaattgtctggtgatgatggcgaagaggtcacacccgttcccatgccgaacacggaagttaagctcttcagcgccgatggtagtcgggggtttccccctgtgagagtaggacatcgccaggcagacttcattccgcagtagctcagtggtagagctatcggctgttaaccgatcggtcgtaggttcgaatcctacctgcggagccattattggagagctgtccgagtggtcgaaggagcacgattggaaatcgtgtaggcggtcaactccgtctcaagggttcgaatcccttgctctccgccactgatacttatacataattacaattgaaagtctgggcccgttggtcaagcggttaagacaccgccctttcacggcggtaacacgggttcgaatcccgtacgggtcattatatgatggaggattagctcagctgggagagcatctgccttacaagcagagggtcggcggttcgagcccgtcatcctccaccattatatcatcgcggggtggagcagttcggtagctcgtcgggctcataacccgaaggtcgcaggttcaaatcctgcccccgcaaccaaattttaaaatggtccggtagttcagttggttagaatgcctgcctgtcacgcaggaggtcgcgggttcgagtcccgtccggaccgccatttgaatacttaggctcggtagctcagttggtagagcaacggactgaaaatccgtgtgtcggcggttcgattccgtcccgagccaccacctatgccggtgtagctcaattggtagagcaactgacttgtaatcagtaggttgggggttcaagtcctcttgccggcactgttttttcaaaatttaatgtggaggggtagcgaagtggctaaacgcggcggactgtaaatccgctccctcagggttcggcagttcgaatctgcccccctccaccatttataggggcatagtttaacggtagaacagaggtctccaaaacctccggtgtgggttcgattcctactgcccctgccaaatttatgacatcttgagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagtctcactttttatatcaactgcatataatgtattaagtccattaaaaatgcggaagtagttcagtggtagaacaccaccttgccaaggtgggggtcgcgggttcgaatcccgtcttccgctccaattacggcggcatagccaagtggtaaggcagaggtctgcaaaacctttatccccggttcgaatccgggtgtcgccttcttattgccggggtggtggaattggcagacacacaggacttaaaatcctgcggtaggtgactaccgtgccggttcaagtccggccctcggcaccaattttacttacatggtaagttgaattggtgtttgtgttttatcattataactaatcatattaatgatctacataagtagatcatttttttaatgctttgatttatcataacaagttaagttccgaggcctagtataaagcggctgtatagctagtctttcaacacttttattttatatttccataaaaacttttttgaaatacgttgacactttatgagatccatgatatatttatattcgtcggttagatacgacgtaaaacttgccggtgtggcggaattggcagacgcgcacgactcaaaatcgtgttccttctggagtgtcggttcgaccccgaccaccggtatactgaaaaacccgtttcttaacagaaacgggtttttattttttattaaagaaaaggagccgaggctcctttttatacttactcagcgtattggtctaggatctcttctagcacctcttctagctcttctgtatcttcaagctctgattggctgaaacggacgcgtacaagctgttctccgtcattatacatctcttccaaccaccctcggagtcctcttgctctgcggtcgacttcgaaaatgatttccaaaccgtcttcgtctaaaaggaaaatgagctctaattcatcaagcatctgacgataatatccggaagtcggaacgaattcgaattcttgaacgaacggaagacgacgctggaagtagggcgcttgttcgcagtctgcttcgttaagacggaagcccaggttttcgattgcttcaagcacattttcaatccaagggtgcgcttcaacgaaaatgcggtcatgatcggatttatcgataccgccttgaatgtcaaggtctgtcaccacggcaacctctactttccctacagtgatcggcgtatctagaggcagagtgaatgtgaacggaaattgatgctcttcaccaggctgtatggtaaatgaaccagtgacccggaaagaatgaattgtagcgtatttccggtgctcttcatcgtcttttacaatgacataccgtgtgctaagctgtaaatcgatataacggatgtcctgagcgatttttccgcctttgacatgtaccgttccctgtacttcttctcctggaaaatatgcgtctttttctaaaattgtatctacttttgcagctccaattccggcacttgccgcaagcttcttaaaaaatgacatgttagatcttcccctttttcttttttctcaacagatatacgtaagaaggaggaaaaaagattcgtttgattcatacttttttcctattattcgtctcggcctagggacagactaagaataatattgaaaataaaggagtggatggaagtgaataaagaaagtttggttgcagatgaattacacagaatgtttttggctggtgagctgcaaatcacagtagaggaggatataaacaatatttccgaaaggctgagaaacggcgatctcagtttagaccgattaagcggtgaagacgtgtttataaaagaaacggtaaatgaggctttaagaagagtggagcaataaaaaagagacggcatctcatctttgagatcccgtctctttttgtggtctttgctgtaagataaaagcgaatcgatttggaattgctcacccgagccaccccttttctaacagaagatctgacagttcatcatggagataaacagctgtatctaattgatcatgcaatgctcttctgatgtggggattttcggttgctgttgttgcgacagtgtatttgttaatgctggtttttattgttgttaacaaatcaagaatatctttgggacaaagactttgttcaatgggaaaccacctcctttgtttttttagcagctcctgataagaaagtatttgactttgtttcttgcttctatacaaaatgctataataagcaacaaattttgttggggggtgtgatgatgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacattggattgcgtgccgtctcatttatctttgtttaagccgccatcatcagatttagcttcttttgttatggaaatggacgtgatttatgttggcgggggaaatacgcggaatttacttgtgttatggaaagagtgggggctggaccatattctcagggaagcatggaagaacggtgtggttgtagctggaataagtgccggtgcgatctgctggtttgaggaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagctgatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtgaaattggctgaatattatctatattcctctttttttcagattgattttatgataagatgagtgcgaaatcaatagttactgggggtgcccgctttcgggctgagagagaaggcaagcttcttaaccctttggacctgatctggttcgtaccagcgtggggaagtagaggaattgtttttgttattgtcttgctgggcaataatatgtttctttctgactgtaaccgggttcatttatatgaatccggttttttgtgctggttatgggcttgattttgtcctttcaaacgtagagaggggaaggaaaagtaatgcaaaacaattcagtgcagcaagccaacatttccattatgtcaagtttttcaggcagcaagaaggtatacgtggagggttcttcttcggacatccaagtgccgatgagggagatcctattgagtccgacgacgggatcgttcggcgaagaggaaaacgcgcctgtgcgtgtctatgatacaagcggaccgtatacggaccctgaagtaaccattaatattcaagaaggattaaagccgctccgccaaaaatggatcacagagcgcggtgacgtggaagagtatgaaggtcgggctataaaaccagaagataacggttataaaaaagcaaatccaaacgtaagctacccaggattaaagcggaaaccgctgagggcgaaggcaggtcaaaatgtcacacaaatgtactatgcaaaaaaggggatcattacacctgagatggaatttatcgccattcgtgagcatgtgtctcctgaattcgtcagagacgaggtagccagcggccgggcgattattccttcaaacattaatcaccctgaaagtgagccaatgattatcggccggaattttcatgtgaagattaatgcgaatatcgggaattcagcggttacgtcatccattgaagaagaagtggaaaaaatgacgtgggccatccgctggggagcggatacgatgatggatctctctaccggaaaagatattcatacgacgcgtgaatggattatccgcaattgccccgtgcctgtgggaactgttccgatttatcaggcgcttgaaaaagtaaacggcgtagcggaggatttaacgtgggagatttatcgtgatacgctaatcgagcaggcagagcagggagtggattattttacgattcacgcgggtgttttgcttaggtatgtaccgctgactgccaaacggacaactggtattgtgtcacgcgggggagcgattatggcgcagtggtgtctggctcatcatcaagaaagctttttatacacacattttgaagaaatctgtgagattatgaaaacgtatgatattgctttctctcttggggatggtttgcgtcctggatcaattgctgatgccaatgacgaagcgcagtttgctgaattagagacgcttggagagctgacgcaaattgcctggaagcatgatgttcaggtgatgattgagggtcctggacatgttccgatgcataaaatcaaagagaacgtcgataaacaaatggacatttgtaaagaagcgcctttttacacattggggccgttgacaacggatattgctccgggatatgaccatattacttcagcgatcggagcggcgatgatcggctggtatgggacagcaatgctttgttatgtaacgccgaaggagcatttggggctgccaaaccgtgatgatgttcgtgaaggagtcattacatataagatcgctgcgcatgcggcagaccttgcaaaagggcatcccggagcgcaaatccgggatgatgcgttatcgaaagcccgttttgaattccgctggcgggatcagtttaatttatctcttgatccggagagagcccttgaataccatgatgaaaccctgcctgctgaaggagcaaaaaccgctcacttttgttccatgtgcggtccgaaattttgcagcatgagaatttcacaggatattcgggattatgcgaaggacaaagagattagtgaatgggatgctattgaagaggggatgaaagaaaaagctgaagaatttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgatcgggacaccgaaggctcttatcttttagataagggccttttttgtatgaaaaaggagggattattgatgggagtcaaaaaagaaaaggggagaaaacgattcaggaagcgaaaaacctacgggaatcagattttgccgcttgagctgctgattgaaaaaaacaaacgagagattataaacagcgcggaactcatggaagaaatttatatgaagattgatgagaagcatacgcaatgtgtaactaaatataaaaaaacccgctgactacagcgggtttttgcatttctccattaagaatcttttttaatcggcaatccaaggccttctgccacgcgttttccgtattcaggatccgctttgtagaagtgctcgatttggcgcagcttgatttcttctttttctaccggcttcatggcattaacgatattttcaacaaggcgggtacgttcatcttcactcattaaacgatacagatcaccggcttgagtgtagtgatcgttgtgatcgtagcttacgctgtcagcgataccttgtaccggatatgctgcttgcttatcctcaggtgactcttttggaccgccgaagctgttaggctcgtaatacacagatccgccgccgttatcatcaaaacgcatttgcccatcacgctgataattgtttactttgttgcgtgcgcggttgattggcagcgcttgatggtttgcaccgacacggtagcggtgtgcatcatgataagcaaaaagtcggccttgaagcattttatccggtgaaacatcaataccaggcacgagggttccaggtgaaaatgtcgcttgttctacctctgcaaagtagttttccggatttctgtctagaaccatgcgtccgacctcgattaacgggtagtctttttgagaccaaacttttgtgacatcaaacggatcgaaacggtacgtatttgcatcttctaaaggcatgatttgcacatatagtttccatgcaggataatcaccgttttcgattgcgttgaaaaggtcttctgtatggtaatcagggttttcaccggcaatttttgctgccgtattgacatcaaggtttttcacgccttgttctgttttaaagtgatatttaatccatacgccttcgccttcggcatttgtccatttgaatgtatggcttccgaagccgtgcatgtggcgaagtgtcgcaggaattccgcggtcagacatcaggattgtcacttggtgcagtgactctggtgaaagtgaccagaaatcccatacagccgtagggtttttcaggtgtgtttttggatctcttttttgtgtatggatgaaatcagggaacttaatcgcatcgcggataaagaatacaggcgtattgttgccgacgatgtcgtagtttccttcttcagtataaaatttaacagcaaatccgcgcggatcgcgaactgtgtcagcagagccaagttcaccggcaactgttgagaaacggatgaacaacggtgtgcgtttgccgacttcagaaaggaaagcggctttcgtgtattttgttacgtcgtttgtcacttcaaaatatccgtgtgcgcctgctcctttggcgtgaacaacacgttcaggaacacgttctcggttgaaatgggccaatttttcgagtaaatgtacatcttgaattaaagttggtccgcgagaaccggcagtcattgagttttgattatctccaaccggagcgccccagctagttgtcagtttatttgaactcatgttatcacctcttggaatttataagaacataatatcatctctaagtaaaaagtcaatattattttataattattataaaatagttatctctattaatcgatatctagtatcgaaagtgttgaaaaaccttgttgtaacagctttttatgacacttaataatttttggagaaataatttttccttctctatttgcgaaacaagcagagtaagtgataaacaaggatatcaaaaatcgtatttaaaaaagagttgacatatcggaataatttgaattaacatgttattcaaacaaaaaaacaattgggcagctgatcggaccgccgaaggctctcatctctacaagaacagagatgggggcctttttgtttttttgaaggcggggttggcagaaagagagggataaaagtggctgtgaccatcagcatcaaagaaaaggcatttgttcaagagggccgcaaaaacacggtcttagagaacatagaattatcaatcgcaccaggcgaatttctaacgcttatcggaccgagcgggtgtggaaaaagcaccctgttaaagattattgcagggcttgattctgaatatgacgggagtgtggaaattaacggccgcagcgtaacagctccgggtattcagcaaggatttatttttcaggaacaccgcctctttccttggctgactgttgagcagaatattgcagccgacttgaatttgaatgacccaaaagtcaaacaaaaggtggatgaactgatcgagattgtcagattgaaaggatcggaaaaagcatatccgcgcgagctgtcaggcggcatgtcacaaagagtagccatcgcccgggcccttctgcgggagcctgaggtgctacttttagatgaaccgtttggtgcactcgacgcttttacaagaaaacacctgcaggacgtgctgctggatatatggaggaggaaaaaaacaacgatgattctcgtgactcatgatatagatgaatctgtttatttaggaaatgagcttgcgatccttaaggccaaaccggggaaaatccataagctgatgcccattcacctggcgtatccgcggaaccggacgactccggatttccaagcgatcagacagagagtgctgtcggaattcgagaaaacagaagatttggagtacgcagaaggatcagggatatagaaagggcggaagcggaaatgaaaaaaggactcattgtattggttgccgttatttttctgctcgcaggctgtggagcaaatggagccagcggtgaccacaaacaattgaaggaaattcgtattggtattcagcaaagcttaagcccgcttttgatcgcaaaagaaaaaggctggttcgaagatgcatttgaaaaagaaggcatcaaagtgaaatgggtggagtttcaaagcggtccgccccaatttgaaggccttgcggcagacaaacttgatttttctcaagtcggtaattcgcctgtgatcgctggacaggcggcaggcattgactttaaagaaatcggtttgtctcaggacggcttgaaagcaaacggcatccttgtcaatcgaaacagcggcattcaagacgttaagggcttaaaggggaagaaaattgcagtcgccaaaggcagcagcgggtttgattttttgtataaagcgcttgatcaagtggggttgtcagctaacgatgtgacaattattcagcttcagcctgatgaagcagcttccgcatttgaaaacggatctgttgatgcctggtccatttgggagccgtacttgtccttagaaacaatgaaacacggagcaaaaatccttgtgaacggagaaagcacagatttatattcaccgggttttactttagtaagaacaaagttttcagaagagcatccagacgaagtggtccgttttctaaaggtgtttaataaagccgttgtatggcaaaaggaacatctgggtgaagcagcggacttatattctgacattaaagatctcgataaaaaggtcgtcgaaaatgtgctgaaaaatactgaacctctgaatgaggtcatcagtgacgacattgtaaaagcgcagcaggaaacagcagattttcaatttcgaacaaaggcgatagataagaagattgatgtgaaggatgttgtcgataacagttttatcaaaaaagcattaaaggaacattcctcaggaggtgatcaatgatgaaagcagaggctgcgggctcgctgcccaaaacgaatgcggaagcggtgcgaaaaaagcccggaaggaagagatacggctttatgaaggggcttttactgcccgctgtcatcattgccatctggcaggtcatcggcgggctggggattgtgtccgctacagtgctgcctacacctgttacgattgttctgacctttaaggagcttattttgtccggcgaactgttcggccatctgcaaatcagcatttatcgggcggcgcttggttttttgcttggcgcagggcttggattgatgatcgggattttggccggattctccaaacggacggagctgtatcttgatccgtcgttgcaaatgcttagaaccgtacctcatctggccgtcacgccgctgtttattttatggttcggatttgacgaagtatctaaaattttgctgattgcgctcggtgccttctttcctgtctatatcaatacgtttaacggcatccgcggggttgacgcgaagctgtttgaagtcgcccgggtgcttgaatttaaatggcaccagcaaatatccaaagtgatattgccggcagccctgcccaatatattgctaggcattcgcttatctctcggcattgcatggctcgggctcgttgtggcagagctgatgggctcaagctcgggagtcggctatatgatcatggatgcgagacagttttcacaaacgaataaagtctttgcagggattatcatttttgcagtggttggaaagctgacggattccttcgtcaggctgcttgaacgaaagctgttaaagtggagaaacagctacgaaggataaaagatataaaggggagatgaatatggaaattctttggtttattccaactcatggagacgcgagatatttaggatctgaaagtgatggacggactgcggatcatctttactttaaacaagtcgcccaggcggcagacaggctgggatatacaggagttcttctgccaacgggaagatcgtgcgaggacccgtggcttacagcgtcggcactggcgggagaaacaaaggacttaaagtttttagtcgcggtaagacctggtttaatgcagccttctctggcagccagaatgacatccaccctagaccgcatttcagacggccggctgctgatcaacgttgtggcagggggcgatccgtatgagctggcaggcgatggcctgtttatcagccatgatgagcgctacgaagcaacagacgaatttttaaccgtttggcggagacttttgcagggagaaacggtttcctatgaaggaaagcatataaaagtggaaaacagcaatctgcttttcccgccgcagcaagagccgcatccgcccatctatttcggtggttcgtcacaggctggaattgaagctgccgcaaagcatacagacgtgtacttgacatggggtgagccgcctgaacaagtaaaagaaaagatagagagagtcaaaaagcaagctgcaaaagaaggaagatccgttcgatttggcattaggctgcatgtcattgcccgtgaaactgaacaagaggcgtgggaagcggcagagcgcttgatcagccacttggatgatgacaccattgccaaagcgcaggcagctttgagccgttacgactcttcaggccagcagcggatggccgtccttcatcaaggcgatcggacgaaacttgaaatcagcccgaatctgtgggcggggatcggcctggtcagaggaggggcaggaacagctcttgtcggtgatccgcagacgattgccgaccggatagcggagtaccaggcactcggcatagaatcgtttatattctccggctatccgcatttagaagaagcgtattattttgcagagcttgtatttccgcttttgccgtttgaaaatgatcggacgagaaagcttcagaacaaaaggggagaagcggtaggaaacacttattttgtcaaagagaaaaatgcatgagtttaactaaaatacagccccccgaacatggtatgatattcaaaaaaagggggctttttttctgaaaacattgagaagcgcggcagtcatttgcctcatagctatgctgtcagcatgcggacattcaaaacagatggaaatcaaagcggcggacatatcagatcttgaaaaaaacagaatggatgtcgcagcttcacaggcattcactgccgaagccgtcaatatcggtgaaggtatttcttcagctgacatgtacatcgaacattatcaaaagggaaagcttgttgagaggtttggaccggttcgtgcagattattcagaggaaaaaactgataccatacaatttgtttattttgagaatgaagagggggaaggaaagaataaacataccaccattcattttggcattgtggataaacagggaactatagcggctgattcatcggtgaaacgcgacgatagcacaacacaggaaatgactcagaatatttcatcgccggaaccgattactttcgagaagcctgctttgatcggcagcagtattagagggactgacgagacaatgcacacctctgaacataaaaaagagctcattaagcatcaagatgcgttactgtattatgtggaattgcatcattagaatgggcggcttcaggccgtctgttttacaaagcggtatgcttgcttttttgaatggtgcatgatacattttaaatcgtaacaatttcgatttaaagggaggctatgtgacttggctaaaaaatcaaaagtggcaaaagagttaaaacgccaacagcttgttgagcaatacgctggtattagacgcgagttgaaggaaaaaggagattacgaggcactcagcaagctgccaagagattcagcaccgggaaggcttcacaaccgctgcatggtaacggggcgcccgagagcatatatgaggaagtttaaaatgtccagaatcgctttcagggagctggcccataaaggccagattcccggtgtgaaaaaagcaagctggtaagaaaaaactccggccgattacagcgcgccggagtttttttcgtttttcttgaaagagatgacgtaggaaaggtgctggatgatcatgatgataaacacaataataatagggaaaaacggaatgcgcgattgaaatagcggataaaaaatgagaagaaccgctgcggcaggcagcgagaagtagacagcgatatatgacgcgcgacatgcttttgccgtcatcatctgctctctttcatcctgctcttcaaactcatcaggcagaagtagctgctttctggcagggcggctttttttctgtaagtacaaataaaccgcagacgccgcaacaaacagaataaagggagtgaggtttaaatcaaataccatcccgccgctctttgtgccgaaaaaagatgctatgccttctgaggcttcaaagtatgaaatcagcgcccagcatgcaaggccaaataaaacaaggtgaaaagctgcttttgttttcatgctcatcttagttttcctcctctaaccaaaagacatcctccattttcatggagaaggctttgcagattttcagtgctaacagcagtgagggaacataatcgcctttttcaatcgctgccacagtctgtcttgtgacgccgaccgtttctccgagtttttcctgagaatagccgaagcgtgccctcagctcttttactttatttttcatcatgacgtctgtccccttcacaatctcgattgattatattgtatagtatacttaacattatgtaaatgtaacttaacaactttacaaaaagataactttttttcgacaaaatttttatattcccttgacgaaaaataaataaacatgtaatataaaaaaagtcagagcggtactgttgctgacaatcacaaatgcgggtgtagtttagtggtaaaacctcagccttccaagctgatgtcgtgagttcgattctcatcacccgctccatacatacgttattaacgcagtgtttcgtttctcagataaacgaagtattgcgtttttttatgtgaaaaagaacacggtattcgtgttcttttacgtaagccaatgtactgtatgggtgccgccgtgaatttgttcaaacattttcgttaatgatgataagaggttaacagcgctgcttttctcaatcgatggcgggaaaaaaatgatttgcagcatattcttagtctcgtttgaaacgggatagtggttgacgctgtttttgaaatcgccaaaaatgccgttttcatcagagaaaagcagtatattttctttttctcccaatgagatccggaccggctcatgaagctttccggcatcataaatcataataggcagagaatattttaatgcgaaaaaatcgattgtgtcatgggccgagtccttactttccatgaattgttccttggatatcgggagcagcatgtcctccattggggttgtttctccctcaaatgaagggttaagctgtttaaagagtttctgccattccttgacgaaggattcatcggatataccgccgtccgcatagtcgaaaaacaaggattcttgaaacaggcggagtctgcctttcagcatttgcggtgaggagccgacttcgatattctcataaatgacagcagctgcatgtaagccggccgcacgttcagtaataacagaatcaagtttgatattcactagcattcactccagttacgtgatatcaacctattataaacgctgtatcgttttatcacaaagaaaggaggctgtgcaaaacatgaacgtttatcagctcaaagaagaattaattgaatacgcgaaaagcattggcgtggacaagattggttttacgaccgctgatacttttgacagtttaaaagaccgtttgattcttcaagaatcactcggctatctctccggctttgaagagccggatatcgaaaaaagggtgacgccgaagcttcttttgccgaaagcgaaatcaatagtggcaattgctctcgcatatccttccagaatgaaggatgcgccgagaagcacgagaactgagcgcaggggcattttttgcagagcctcctggggaaaagactatcatgatgtgctgagggaaaagcttgatctgctggaggattttctaaaaagcaagcatgaggatatcagaacgaagtcaatggttgatacaggtgaattgtctgatcgcgccgttgcggaacgtgccggcatcggattcagtgcgaaaaactgtatgatcacaacacccgagtatggctcttatgtgtatttggcggaaatgatcacaaatatcccttttgagcctgatgtgccgattgaagatatgtgcgggtcctgcacgaaatgcttggatgcctgtccgacgggagccctggttaatcccgggcagcttaatgcgcagcgctgcatctcttttctaacccagacaaaaggatttttacctgatgaattccggacaaaaatcggaaaccgcctgtacgggtgcgatacgtgccaaacggtatgccctctcaataaagggaaggattttcatcttcatccggaaatggagcctgatcctgagattgccaaaccgttattgaagccgcttttgaccatcagcaatcgggaatttaaggagaaattcgggcatgtctcaggttcttggcgcgggaaaaaaccgattcagcgaaacgccattctcgcgcttgcgcattttaaggatgcttccgcactgcctgaattggcggaactgatgcataaggatccgcgtcctgtcatcagggggacagccgcatgggcaatcggaaaaatcggagaccccgcatacgcggaagagcttgaaaaagcgctggaaaaagagaaggatgaagaggcaaagctggaaattgaaaaaggaattgatttgctaaaagcttcaggcatgactaaacaaggcttgtcctgacatacgtatagagcagaaggaaaaaacacttgagatcatccaagtgttttttctctataaaaaagtatggcgggtggggtgagcttgaagcacattttagaacaattagcggaggagaggctgggctttctggttaacgggcatgctatgagacaggagtctcaagtcggagaccttaaagtcatggagcgtaagaaaaagcttctggaaaaacgtaaagttgacatcataaaagcgaaagcaaaggccgtgattaatcatgtgcgggttgaggatgacggaacgacctgcctttcgtataccatccattacgaatacgtgtgtaaggaacaagatgacagcttgtatatagaagagcacatagaggagcgaatggctttcctgtatgatcacattttgattagtgatcaggaaattgcgaaaaagccggctggatttcatgaagggaccagtattattgactattctgaagctgaagaggaaagagaagcgtttggcagggcttttcaatacgatcgtctcggcgctgtccaatatgccgagaaattttggaacaagcgcaatcctgcttataaaaatttcagcgataactgtacaaattttatttctcagtgtcttcatgcaggaggcgcgccgatgcgcggtcacccgaacaggggatcaggctggtggatgaaacaaagctcatggagctacagctggacggtggctcactctatgaaaatgtatttgtcgaattcaaaggccggactgcgtgcggtgcgggtgaaatcagcggaagaactgatgccgggcgatgtgatttgctatgacttcgaaggagacggccggtttaatcatacaacgattgtcgtggcaaaggacaaaggcaatatgccgcttgtcaacgcccagacctatgacagccggatgaggtattggtcatatgaggattctacggcatacacgccgtcaatacgatatgccttttttcatatcgttgatgatacgacaaaagagtaattaatgttataatgatgggcggataagaaaaacagaggtgaacattgtggcattacatgtcgttttatatcaaccagaaattcccgctaacacagggaatattgcacgtacttgtgcagcaaccaatacaacgctacacctgattcgtccgctcggcttttcaacggatgataaaatgctgaagcgtgccggactcgattattgggagtttgttaacgttgtgtatcataattcgttagaagaattgtttgaggcatataaaaaaggcaagtttttctttattacaaaatttggccagcagcctcatacatcatttgattacactgatcttgacgaggattatttcttcgtgttcggaagagaaacaagcggtttgccaaaagatttaattcaaaataatatggaccgctgcctgcgtcttccgatgacagagcacgtcagatcgttaaatctgtccaatactgccgcgattcttgtttatgaagcgctgcgccagcaaaattaccgtgatttaaaatagtgaaaaaacccgctcatcgatgatgggcgggtttttttgcggatgttgaaatgctttgtttcgtttttgggcttaacaacgtaacagtgttatgttacaatgtacccatcaaaggagctggacttatggaagaacaattaatctctaaaaaagaattacttgaaagaacatcgatttcatacggtcagctgtatcgatggaagcggaaaaacttaatacctgaggaatggtttattcgtaaatccacatttacagggcaagagacgttttttccgagagaggagattttaaaacgtatatcaatgattcaaaagatgaaagaaaatttgtctttggatgaaatgagggaaatgctgtcgccgaaaatgaaggatgtcagcatgaccgctgatgaattgcttcataaaggtttggtttcaaggcctgctcttgaagcctattcagaagacggaggaagtccggttttttcatccagcgatttgctttcgctgtttgtgcttgagggcctgctgcagtctggaaatgtcagccttgcagaagcaaaaatggctgcagaggtattaaagaagcatgatactgaagagattgaaaaacagacggagctgattgtgctccgcaagctcggtgtcacaacttgttttatagcggctgcggcggacagcattttgtttgaatcatccgtaaaggttgtggaacgggtagatttattaaaagcttcagaggaattaaaaacaacatttatgcaggagggccatcaatggatgtagtggaaaagctggtgataaacggatcaggaagttcaaagggaggaacatttcaatctgttgagattaatggcagcgggacagtggccggggacgtggagtgtgacactttttcttttaatggaaacggaaaagccgacggcagcgtcaaagcgaaagcggtaaccatcagcggttcaggaaagatacatggagacgttgaagcagaatctatccggatgaatggcactggttttattcaaggagaggtatctgcaaaacaattgaaaatcgctggatcatcaacatttggcggcactgtcaaggctgatggcattgacattagcggaaaagctgtcatggaagcagattgtgaaacagaaacctttcaatcagaagggaaatgcaaaatcagcgggcttttaaatgcagaccaggtgatcattaagctttctgcaggggaaagctatgtgcgggagatcggctgccgccatcttcaagtgacctgcagaaaaggaatgctgacattgctcagattaatgccgcagcctgttctaacagcagagctgatcgaaggtgacgtgattgaattgacaaatacaaaggcgaaaaccgtgcgcggaaataaagtggtcatcggcccggattgccagattgaaaccgtcgaatacagtggggactatacctgtgatccaagcgcgtcggttgaaacatccacaaagttgtaaggaggatcgtaatggagacaacaaaactgggaaatttaaaattatatggcgctgggcatgccgcaggaggcgcgtatcataatgtcagcatcaaaggagaaggtgtagttggagaagggctgtctgctgtaggctgccgcatatacggaacgggcctttttctcggaaaagcagagactgagcggctgcgtgtgcttggagaaagtgaatgtaaaggcgatctgacagccggcaaaatcaatatatatgggacaatgaaagtcagcggctcacttcaatttgatcgattcaatctgaaaggccagactgaaattggcgggaatatgactggagaatcctgcgatgtgaaagggaagctcagcgtaaaaggtgattgtgaaacagaaatgttccatgtcacaggctgtgttgatgtatcggggttattaaattcgggtgagatcaagctgggattgagccatgatataagtcatgtgcaggaaatcggcggaacaacaattacagtgaaaagacgcgcgagtttttttaaccggaagaaagtgaagctgttcgccgatgtcatagaaggagatcggatttatttggagaataccgaagcggcagttgtcaggggaaaagaagtgatcatcgggccgggatgcagtatcggaacaattgagtacgaaaacaaatatgaatgcgatccgcattcacagattaaagaaaaaacaaaactgtaaaacattgttctgttatacaaaaagggtgctctttcaggagcacccttttttattcttttccaggcttgctttcgtatcctgcggtaaaaattgatactaaaaaagtgacaatgacacccatcatgatgattgttttcaccgtctctccccctcttcaatttttccgtgctgtccgagtctggatgattctgtatttttctttattatgaacggtcgcggtctgccttgtcaacgatgtataagtatctttatttttaagaaaccaaagcatgtatcacgagatggcggcatagattgtatcaaagtaccttatttgcatagtgtatcaaacatgatagaggaggtccttatggatatattaaagaaaattgaacagtacagagaggaagagcagcggctgaaatgggaaggaactttcgccgattatttggagattattaaagaaaatccgatggtcgcgcaatctgctcattctcgagtttttaatatgataaaagacagcgggatagaggagattgacggacgcaagaagtacagtttttttgaccgcgagctgttcgggcttgaagaatctctggagcgtcttgtggaagagtattttcatccggctgccaaacgtctagatgtcagaaagcggattctattgctgatggggcctgtgagcggcggtaaatccacgctggtcacgatgctcaaaaaaggtctcgaagcgtacacgctgacagataatggcgctgtatatgcgattaaaggctgcccgatgcacgaggaccctctacatttaatcccccatcatttacgcgatgacttttacagagaatacggcattagaatagaaggaagtctttctcctttaaatgtcatgaggctggaggaagagtacggaggaagaattgaggatgtgaaggtggaacgcatcttcttttcagaagataagcgtacgggaattggaacattcagtccctctgatccgaaatctcaggatattgccgatttgacggggagtattgatttctcaacaatcgccgagtacggttcagaatcggatccgcgcgcttaccggtttgacggagagctgaataaagcgaaccgcgggatgatggagtttcaggagatgctgaaatgtgatgagaaatttctctggcatttgctttccttgacacaggaagggaattttaaagctggacggtttgcgttaatttctgctgatgagctgatcgtggctcacacgaatgaaacggagtatcgctcatttattgctaataagaagaatgaagccctgcactcaagaatcatcgtgatgcctgtcccttataatttaaaagtgtctgaggaagagagaatttatgaaaaaatgatcgcagaaagcgatgtggcggatgttcatattgccccgcatacgttgaaggtcgccgcgatgttctcaatccttacccggttaaaagagccgaagcggtcggatattgatctggtcaagaaaatgagactgtatgatggagaaagtgtggaaggatataattctgtcgacgttgaggatatgaaaaaagaatataatgatgaaggcatgagcggcattgatccgcggtacgtgatcaaccggatttcttcaacgattatcagaaaaaatatggaatcgattaattctctcgatgttcttcgctccttaaaagaaggtcttgatcagcacccatcaatttcaagcgaggacagggagcggtatttgaattttatttctgccgcccgcaaggaatatgacgacattgcgaaaaaggaagttcaaaaagcgtttgtgtattcgtatgaagaatcagcaaaaacacttatggacaattacctcgataacgtagaggcttattgcaataaaaacaagcttcgtgatcctttgacaggagaggaaatgaaccctgacgaaaagctgatgagatccatcgaagagcagatcggcatttcggaaaacgccaaaaaagcgttccgcgaagaaattttaatccgcatctcagcctatgcgagaaaaggcaagcggtttgattacaattcccatgaaagactgcgtgaagctattcagaaaaagctgtttgctgatctgaaggatgtcgttaaaattacgacctctacaaaaacgccggatgaacagcagctgaaaaaggtaaatgaagtcgtggcccgtttaattgatgagcacggctacaactcgacgagcgccaatgagctgctgaaatatgtcggcagcctgctgaaccgataagcaacgtgacccgtccgaatagggcgggttattttgtcccattttctaaatagtttgtcaattaaatgtgcttttatgcatatgatgaatataaatcttttcgaaagacttgtttcataatttggcacaagccggaatacgtatgtatcacgaccacaaatggttaaggaggggaattcatgtcccaaaatgacagcggccattttttgatttctgaggaaaactggtccctccatcgcaaaggcttcgatgaccagcagcgccaccagaaaaaagtgcaggaagcgatcaaaaacaatcttccggacctcgtaactgaggaaagcattattatgtctaatggaaaagatgtagtgaagatcccaatccgttcacttgatgagtataaaatccgttataactatgataaaaataaacatgtagggcaaggagacggcgagagccaggttggagatgttgtggcccgggatggatcagacaaaaaacaagggcctggaaaagggcagggtgccggtgatcaggcaggcgaggattattatgaagcggaagtttcattaatggatttagaagaagcgctttttaaagaattagagcttccgaatctccagcaaaaagagcgggacaatatcattcatacagatatcgagtttaatgatatccgtaaaacagggttaaccggtaatattgataagaaaagaacgatgatgtcagcctttaaacgaaacgcaatgtcaggaaaaccgtcgttctacccaatttatccggaggacctgaaatataagacgtggaatgacatcacaaagcccgaatcaaaagccgtcgttttagccatgatggatacaagcggcagtatgggggtttgggaaaaatacatggccagaagcttctttttctggatgacccgttttttgcggacaaaatacgagactgtggaaattgaatttattgcccatcatacagaagcaagagtggtctcggaggaggattttttctcaaagggagaaagcggtggaaccatttgttcttccgtatatcggaagtcgcttgagcttattgatgaaaagtacaatcccgcccgctataacatttacccgtttcatttttctgacggtgacaacctgacatctgataacgcgcgctgtgtgaagctggtcaatgatattatgaagaaggccaatctgttttgctacggcgaggtcaatcagtacaacaggcattcaacgttaatgtctgcatataaaaatgtaaaagatgagaaatttaagtactatattttaaaacagaaatctgatgtttttcaggctctaaagaactttttcagaaatgaagagtctggtgtaagccatcaattttcgtaatgaaaagcccatttcagggcttttttttatttaataaaagcaagaaaacgcttgcgaaaaaaatacgggagaaaaagaaatttttcctttgacaaatcttctttcatttattaatattttatcttgtgaactattattgaggaatgaggtgaaaaggagttgactgaatcagaacgtgctttgctcacttttgaacagctcttcgatacgtctcgggcgatatataaaaaacagaagaagatattggagattgtgcttgagccttttgatattacagtccttcaatatttgctgatgtttaaaattcatcaaagcggaagcaccccgctaagcaagctggcaatgtcgcttgatcttaagcctgcttctgtgacgcggatgacagatattctgtataagcgccaattgatgaatcgatatgacagtccggatgaccgccgtatcgtcatgattcagttaaccgaagagggggaagaactgatagaaaaagccgctgtgcaatatgcaaaaatgggtgctggcttgtaccaaaagcttgatacctcccagctgcagtatttgcgcaaactagccggaagtttaacgaagcttgctgaaggctgttcagaaaaaagcggtaattaaaaacttctcacatattttcaccagctttccgcaaaatgatagaggatgaaacgaaaggagaaaacaaaatgaacagaggacgtttaattctgaccaacattatcggtttgattgttgttcttgcaattatagctggaggtgcttactactattatcaaagcacaaactacgtaaaaacagatgaagcaaaagtagcgggcgatatggctgctattactgctccagcagcaggtaaagtatctgactgggatctggacgaaggaaaaacagtgaaaaaaggcgacacagttgcaaaaatcaaaggtgaacaaactgttgacgtaaaatccattatggatggcacaattgtgaaaaacgaagtgaaaaacggacaaaccgtacaagctggtacaacaattgcacaaacgattgacatggacaacctatacatcacagcaaatattaaagaaacagatattgcggatattgaagtaggaaatagtgtagacgtagtagttgacggagaccctgatacaacatttgacggtactgtagaagaaattggctatgcgactaactcaacttttgatatgcttccatctacaaattcaagcggaaactacacaaaagtaacacaaaaaattcctgtgaaaatttcaatcaaaaacccatctgataaggtgcttcctggaatgaatgcatctgttaaaatttctgagtaaaacagatcagtcatcaaaccatgaaaggaggttgtcttagatggctacaggcaaagaaaaaaatgcaaaaaaccctatgtcattgctgattgtgctaatggcgggtttatttttggcaatcctaaaccaaacactgcttaatgttgcaatgccgcacttaatgactgaatttggcgtaagtgcaacgacgattcagtggctgacaacaggttacatgcttgttaacggtgtattgattccgttatctgctttcctgattacacgatttggccagcggagtctctttctcgtcgcgatgttttgttttacgctcggtacgttagtctgcggtatcgcacctaacttctctacaatgctgatcggccgtttgattcaggccgtgggcggaggtatcttgcagccgctcgttatgacaaccattctgttaattttcccgcctgaaagcagggggaaaggaatggggattttcgggctagcgatgatgtttgctccagcggtcggcccgactctttccgggtggattattgagcattatacatggcgcattatgttttacggacttgtgccgatcggcgcaattgttatcattgtggctttcttcatctttaaaaatatggtggagccgcaaaaaatcaaactcgatactcttggcgcaatcctctcgattgtcggattcgcttccttattatacggagtcagtgaagccggatctgacggctggaccgacccgattgtattgtctacagttattatcggagccattgcaattgttgcttttgtggttcagcaattgcgtcatgatgatccgatgcttgatttcagagtgtttaaatatgacattttctcactctcgagtgtcattaatatcattattacagtggcactttacactggtatgttccttttaccgatttatctgcaaaacctggtcggctttacggcgcttcaatccggtctgcttctgcttccgggtgcgatcgttatgctgattatgtcaccgatctcaggtattttgttcgataaattcggaccgagaccgcttgcgattatcgggcttctcgtgacagtggtaacaacgtatcaatacacgcaattgacaattgatacaccatatacacacatcatgctgatctattcaattcgtgcatttggtatgtctctcttaatgatgccagtcatgacagccgggatgaaccagcttcctgcccgtctgaacagccacggaacggcgatgagcaacacgcttcgccaaatcagcggatcaatcggaacaagtttaattacgacgatttatacaaaccggacgacattccattattcacaaattgcagataaaacaagcacggcggacccgaacttcctccatgcgttccaaaatgcagtttcgaatttaatggtgaatatgaatgtgtcttatgatacggcgaaaacatatgtgtactcacatatttataaacacgcatcactcgattccaatgtcatggggataaatgatgcctttatgtgggcaaccttattctgtgtagcaggtttgattttaagtatcttcctgcgtgacgtcagaaaagataaattgcgtaagaagaaaaaagaggagctttcattacttcctgctccaaaagaagctaaggaatcttaatctgtacagggaggtttcctgaatgaaaatttatgtagtgtatgatagtgaaggcgaacatactaaagtgcttgcagaagcgattgctgaaggcgcgagagaaaacgacgcggctgaagtgttcatcgaccatgtagatcaggctgatatccgcaagcttaaagatatggatgcgattatttggggatgcccagggcatttcggaacaatcagctccggtcttaaaacttggatcgacagacttggctacttgtgggctgaaggcgagctgatcaacaaagtcggtgctgtcttctgcacaacggcaacaacacacggcggcttggaaatgacaatgcacaatttaatcacgccgatgttccaccaaggcatgattgttgtcggactgcctggcaacgtgcctgaaaacgcactttatggctcttattacggagcaggtgtcacttgtccggtagacagtgatgagttaatgtctgaggaaggtattcagcttggacgcgcgttgggaagacgtgtcagccaagtcacaggaaacctaacagcaggacagtaaggagaggttgaaatggccattattatagcaataattgctgctgtcattgtcattgcggcccttattacatttaacgtccgcaacgcctcacctggacctgagaagcaagaagcaaccgatagaatcgcacctccagaagaggaaaaaaacgaagcgcattaccctgctgaagcaagggctgccgagcatacgccatccgttgtcaaaaacgattctccaaaagagaagcgtgacacaatgggtgatgatatttacaggcaggcgctgcaaaagtttaagcattctgatgaagttcatgcagaagaagaggtcactgaggaaagtgacaaaatgcaggaccgcagctatcgtgatgcgctgctctctatgaaaaataagaaaaagtaatgaaaaaggcaaatccgtttactcatgcgggtttgccttttttgctgtttccatcaattatgtttttatcaaataaatccatggaatatgttgtattccaccttgatctagtgtactatgttactcatacaccgaggattttttccgggaggtaaagacatgaattcttttttaggtttattaaagaaagatatcaagctttcaagaatgtggctgctagtatggatatgcggaatcattttcttattgggaacaggccatattatagcttctcgcacgaaagaacctctagtcatttttggtttttttgttgcagttgctttttttctgcttttcttatctcctgtttttgtgttttatcaccttcgcaaggaagggaaatcacagctttggctgtacaatccaaatggcggcttatggctgttttcttctaaattggcagcatctttgctctatcaatttgtgattcagttggcattaacagcctatggcatatggatgtatcatatgctctctgtaaaaaatctgctggagcatcaagttgatataacgagtacagtggctttgctgaatatgtatgggcttatttcttcgttagatatgtcagtaacagtcattgtgttttggactgtttttcactctctcagaaattggcgcggaatgcggtgggctgcgatggttctgttggttgcagtgtggttattcttcgatgaatacatcataagccctttggttgaatctcaaaagcatttctggcctgtaacagtctattgcaattttgatttccacttccacaatgtttggagattggaactaaaacctatccatctgtctgtgctagggttgcctattactttagtcatcacattcttgctgcttatcatggcttcaaaactgcttgatcgtaaagtagaggtgtaaatatggacaatcaattccaatcctcgaaaccgatttatctgcagatcgctgatcagatcttttataggctggtcaggaaggagctgctcccaggagacaagcttccttcagtaagagaaatggcgattcaaactaaggtaaatcccaatacaattcaaagaacttacagtgagatggaaaggctgggtattgtggagacaagaagaggtcaagggacgtttattgcggaaaaagcagaaatcgtagacgagctgaaagacaagctgacacgagaggtgctggaaggatttgtcaagcaaatgaaagagctggggctaacgaaagaggaaatgttagaagggattaaaacattcacagagggaggctaaaatggaaatcaagctagaacatgtatcaaaaaaatacggccgccatacggccgtcaatgatgtgtcaatcaccctatcatccggacggatttatggcctgatcggaccgaacggcagcggcaagtcaacgaccctgaaaatgatggctggccttctgtttccgacttcaggatttgtaaaagttgatgaagagcaggttacgagagaaatggtgcgtcaaacggcttatcttactgagcttgatatgttttatccgcatttcactgttaaagatatggtgaatttttatcagtcgcagtttcctgattttcatacagaacaggtttataagctattgaatgagatgcagctgaatccggaaaaaaagatcaaaaagctatcaaaaggaaatcggggcaggctgaaaatcgttcttgctttagcgagacgggcagacgtcatcttgcttgatgaacctttttccgggcttgatccgatggtcagggattccatcgtaaacagccttgtgtcgtacattgattttgagcagcagattgtcgtgatcgcgacacatgaaattgatgaaattgagactttgttagatgaagtaatcatcctcgccaatggagaaaaagttgcgcagcgtgaagtagaagatattcgtgaacaggaaggcatgtctgttttgcaatggtttaaatcaaaaatggaagtttgctagaaagaggaggaatatgatgaaaacagtgttggaattgaaaaacgtgactaaaaacatcagaggccgaacgatcattgatgatctcagttttacgattcgtgaaggcgaggtattcggttttttaggaccaaacggagcggggaaaacgacaaccatccggatgatggtggggttaatgaagctgtcgaaaggtgatgtcctcatttgcggccaatcaattacgaaagaatatgccaaggcgattaagcatattggagcgatcgttgagaatcccgagctgtataaatttttgagcggatataaaaatctccagcaatacgcaaggatggtcaagggtgtcacgaaggaaaaaattgatgaagttgttgaactggtcggtttaacagacagaatccacgacaaggtgaaaacatattctctggggatgagacagcgtcttggcttggcacaatgccttctgcacgatccgaaagtgctgattttggatgaaccgacaaacggccttgatccggcggggatcagagaaatcagagatcatttaaagaagctgacccgagaaagaggaatggctgtcatcgtttcaagccacctgctgtcagaaatggaactgatgtgtgatcgaattgcgattctgcaaaaaggaaagctgatcgatattcaaaatgtaaaagatgaaaacattgatgagaacgatacatatttcttccaggttgagcagccgaatgaagccgctgctgttttaaatcagtacgatttgctgagtaagacaaatggtgtagaaatcaaactggctaaagacgaagtccctgcggttattgaattgctggtgatgcagcaaatccgtatttatgaggtcaaggttataacaaaatcattagaggaccgtttcttagaaatgacaggtgaaacaaaagaggaggttcagcatgcttaatttgatttataatgagtggctcaaaattttcagccgtgccggaacatgggtgatgatcggaattctggggctgacaatggttggatttgcatttttggcgaatcatttttctgctggtgaatcaaattcccattggaaacaagaacttcaagcacaaaacgccgaattaaagaaagaaatcaaagaagatccttcactgaaagatgggtataaagaaacaatcacactcaacgactatcgcatcgagcataatatccctagtaacacgggctatacggtatggtcttatgtaacggattcagcaaactttaccatccttaccggtctgtttactattatcatcgcggccggaattgtcgcgaacgaatttaattggggaacgattaagctattaatgattcggccgctcagccgttttcaaattttgatgtccaaatatattacagttctcctgtttgggctcctattgctgttgattttatttatcggttctactttattagggttgatcttcttcgggacgggtggtgaaaccgccgcgaatattcatttaatctataaggatggccatgtcattgagcaaaacatgatggggcatttggccacaacgtatctttctgaatccgtctcggctttaatggtggcgacgatggcgtttatgctgtctgcggtattcagaaacagctctcttgcggttggtttttccatcttcttgttggttgccggtacgactgcaactgcatttattgcagcgaaatttgactgggcaaagtatatattgtttgctaatgtcgacttgactcagtatgtggatggcacaccgttaataaaagggatgactatgacgttttctctcgtcatgctagcgatctactttatcatcttcctgttgcttgctttcggaatcttcatgaagcgggatattgcaaactaataaagaaagctgttttgcttatgcaaaacagcttttttgtcaaaataaaaactgcaggtttgcacctgcagtttttcatatcaatttatgcttacgcttctttagtaacgttagcagcttgtggtccgcggtttccttcaacgatttcaaaagaaacagcttggccttcttctaaagttttgaagccttcgccttgaatagcagagaaatgaacgaatacatcgtcttgaccttctacttcgatgaatccgaaacctttttcagagttgaaccattttactttaccttctaacatgaaatttcctcctaaagcgatcataacgcttaaattcactattcttgctcttaacaaactttcaagacgaaaactcttacaaaactttcttcttaaagatagttcgaacaaaaataattacctttactctaccagtaatcttcagaaaaaacaactgcttattgaaatttttttcggaaaataccatatttatttttcaatttgatatttatttacggaaattcatctgttttctcgatatgtgatcatacgtttgccttagtattccttcattttgggaagataagtaataggaattgacaaccttattggatatgagtaaggtaaaagttaatcaatattacaaatgacaacgtttatcaactaagagagcgtatgatttttatgtctgatattgcttgcatgctctaatacatagataggagtatggtcacaatgaaaaagtggcttatatgcagtttcgtccttgttcttctcgtttcatttactgcatgttcaccgtctgcagaacatgaatcgataaaaatcgggattgctgagtctgacggggcaatatggaactatattgctcaaaaggctgaagaggcagggctggatattcagctgatccctttttctgattatgcggagtctgatatcgcacttgctaacaaagaaattgatgccaacgcctttcaaaccatttcatattttcagtcgttcactgaaaaatacaaacttaatttggcaccgctcgggacgacatacataacgcccatgggcatttattcaaaacgatatgaacgaatccgagatatatcgcggggagctgtcgtttctgttccggataaagcgttcgattttggcagggcgcttacggtgctccaggaagcgggtttgctaacgctgaaaaacggatttaacggaacaggttcagttgatatgattaaagataatccgagacacctgaaattaaaagctgtccggcaacaggatgcagtgagcggtgccgacgtgtttgtcatgaaaccatcagaagcaaaaaaagcgggcttgaacccgaaaaagcatacgctaaagagcggcggactcatgtctgaggaagagatgaatttgattgttgtcagagcggaggatcaagatcgggaagcgctgcaaaccattcttgagctttatcaaagctgatgatacagcggcatttatagaaaaagaatatcagggagatcttgtcccggcttttctgcctttgaaacgtctttcagattggaagaatgaattcgaacattgaattcattcttttttttctgaaaaacacactctgttccgtcccgtttctttcgctttgtaaagcatttgatcggcaagaatgggcaaggatcctggctgttccgtattattggggtaatgagcggcccctagtgatatcgtaactgaaagctcgtcgccgtttgttaatacaatcggtgcatcacttacagcgctcctgatccgttcagcgatccgggctgctttatcaagagaacagttcggcaggagcacggcaaattcttcaccgccgatccgagcggcaggatcagtatttcggatgctctgcttcagacgtaaccctagctctttgagcacctgatctccttcatgatggccatattggtcattgatggtcttaaaatgatcgatatccatataaatcagtgcaaattgaaaatgcggggtatcggccgcctgctgatacagagcttttgtggtttcttcaaactttcttcggttatacacgcctgttaaaaagtcaaagtgcgcctgaaacttatattgtttaaaaagaagatgtgcatttgtttcatgatcaataatatataaactgagcatgccgcccgctattgatatgatccaaaaatacaaatgaagttcgtatgaatgtaaatctataagaaaataaaaggaaaaggagatcaagctatttgtgattattaaaagatagaaagcatgttttagttgaactttttttcttctagaaacaatgagtgacgggatggcagcgatacaaatgataataaccgagtatagtgcagatgtgttcattgtaatcagcaagcggcctgcagtgatcatggccagggccgttgccgttgaaacccagcctccataaagagcggcaatcataatagggatatttcgaagatcaataattgaatgctgataggtaaatccaaaaaccatcagaataaccccgagtaaaccgcaggccagtcccttaacagcttgaaaagatatgctgtcttttttatgtactaacctttctttaaacaggtgggtgaagagataattaaatgtgattaaaatggtcaaatttacaaacagttctttcagcaatattatcacccttatataaggtactaaagatggaagggaaagaaaagaacaaaaaaggcattatataaggtttttttacttgaattgataagttaaaataattcgcacttgacccatcggaattagtgtaatatagtaaatgagaaaatttgaagggagagtttacctgctttggagactttactggttgtattacatgtatttattttatttttacttatcttagggctctttgttatgcagaaaaaacatgtttccttctctaaacgtgtatttactgcgctggggctgggaattgtattcggatttgcgcttcagctgatttacggcccgacttcaaatatagtcattcaaacagccgactggtttaatattgccgggggcggatatgtcaaattgcttcagatggttgtcatgccgctcgtctttatttcgattctcggcgcatttacaaagctgaagctgacaaaaaatcttgggaaaatcagcggtttgattatcgggattttagtagcaacaacagcagttgctgcagctgtcggtatcgcgtccgcgctttcatttgatctgcaggcgattcaggttgaccaaggaagtacagagctttcacgggggcaggagcttcagcagaaatcagaggatatgacagcgaaaacgctgccgcagcagattgttgaactgctgcctggaaacccgtttttagatttcacgggagctagaccgacttcaacaatcgctgtcgttatttttgccgctttccttggagtggcattcctcggcgtcaaacacaaacagccggaacaggcagaaacatttaaaaaactggttgatgccgtttatgccattgtcatgcgtgttgtcacactcattttgagactgacgccttatggggtgctagccatcatgacaaaaacaattgccacgagtgatcttgacagcattttaaaactgggcatgttcgtgattgcttcatatgccgcgttaatcactatgtttatcattcatttgctgctgctgacgttcagcggcttgaatccggtgatttatttgaaaaaagcggtgcctgtacttgtatttgcatttacgtcaagatctagcgcaggtgctttaccgctgaatattaaaacacagagaagcatgggtgtaccggagggaatcgcaaactttgccggttcgttcggtctttcgatcggccaaaatggatgtgccggcatttatcctgcgatgctggcgatgatgattgctccgactgtcggccaaaatccatttgacccggtgtttattatcactgttatcgcagtcgttgccatcagctccttcggggttgccggagtcggcggcggagcgacattcgcggcgcttcttgttttatcatcattaaacatgcctgtcgcgctcgccggtttgttaatctcaattgaaccgttaatcgacatggggcgtactgctttgaatgtcagcggaagcatgacatccggtcttattacaagtaaggtcacaaaggaaattgatcaaggggcatttcatgatcaatccagagtgattgaagctgaagaagcgtaacatatgaaaacgtgtaatccgacagggattacacgtttttttaacggccgggttctaagtcctccagcatttccatcatcgtgttgtcgtccatgacattcattgcgctttgttcaaaatgaatgggttcagcataatgcggctgtctttttttcgtggctgtctcagtttgcctagtttgagactgtgtatgctgatgctgtggttgctgctgtccagcgtgctggtgctgacggccattttgccgctggctttgatgctgcgaacggtcctggttatcaccgctgcttccgctaaatgcttgtttgaccatgtttcctacattagaagcatcaaacgtgttattttctgaatttcgtctgttcatttgtcctgtgataaacccgctgattctttggcggatctgaggtgataatgcagcaataagcatagttgatcctatgatcaatgctgcggggctgattcctcttcgctggttgaacaacatgatccctcctttgcagtgtattcatattttccccctcgttagacaaattaaccgttatatttcccgggaaagcatttcctccagatttgcatgcataattaaagccagttagaaaaacctataagtaaagtgataaaggaggaattcacatgtttggaaaaaaacaagtccttgcgtctgtgcttcttatccctttgcttatgactggctgcggtgtagccgaccaaggtgagggcagacgtgataataatgatgtaagaaacgtaaattatcgaaatccggccaatgacgatatgcggaatgtaaacaatcgggataacgttgacaacaatgttaatgataatgtcaataacaatcgtgtaaatgacgataataacaacgaccgaaaacttgaggttgctgatgaagcagctgataaagtaacagacctaaaagaagtaaagcatgccgatatcattgtggctggaaatcaagcctacgttgcagtcgttttaaccaatggaaataaaggtgcagtagaaaacaatctgaagaaaaaaatagccaaaaaggtaagatctactgacaaaaacattgataatgtttacgtttcagctaaccctgattttgtagagcgtatgcaaggatatggaaaacgtattcaaaatggtgacccaatcgccggattatttgatgaatttacacaaactgtacagcgcgtattccctaacgctgaataaataaaaaaagccgcacaatttgtgcggctttttctttgcgttaatgacacactgcgaactcaggctgcatagagtaaaaataaaaaggtacaagacggaccggctcagggagggagacgtttgcgggatggcataggaaagcgtgcggcatccgctctattcctgtgcggagtccttgtgatgctggctgtgagctcagccatcgtatcaagcgcgatgtatatcctgtcttttccaggtcaggcatctggaataacaaaagaacaagtgacgaagcacatgaagaaagagtcattcaaacaggccgatatttattacacttctaaggaaaagtccttactgccattgacgaaagaaacgcttgaatatgcggtcagtattaatcagattatgattggatattcgaatcaaaagcctattgacattatttttttcctaatgaaaaacagatggaggcttactccggtttattggatgtagttggtttttattctgaacgggagcagctgatcggattgttgcctgaagagaaaaagaaactgttagaaggggacgaggtagcggtttatttataccagagattgttgattcatgaatactcgcaccatgcgtttcaccagaaattgaaggagcttgagacggatcccgatgagtttccgttatggtttcatgaagggttaagcgagtggattgcgaactatgaattgctcatagatccgatcacgttttctgtcgtgccctttgaccgtttgcagactgatcgagactggcaggaagccagagccgaatatgacactgatgtctatttgcaaagcttttatatgatcgatgagctgacggacaaatatgggaaagacattatttcagaaatgattaaggaaacagcaaaaaaaggggactttgaaaaagggtttaaatcagcaacaaaggcaagtcttgatcaatttgaaaaagatttcaagaaaaaatttgaaaaaaacagtgcggcattggatagtttctatccaatgcctttgttattagtgaagtccttgctgacccattccgccttgtgtcggaggcatttgtccttgggcaggggcgaatgaatttctcagctgttccatatcctgcgcatcaagctgaggaacctggtaatagccgtgtttgttttggtataggaaaatttcaaatgccatttcaacatactcctgaatttgcgcagacagtacgcgtcttacggccggatttgtcatttccagagaagccatcgtcagcatagaagcttgtgctttaatcgcgcaaagcatttgtcggctgatgatgctgtcatcaatatcattcatggattgaacaggttttttaggctgtgacggctgcatgccgtaaacagcctggttgtcctccttcatcatataagttgctgttttttgtgaaggttcgctgcctgttttgaagcattctgcagttatattgtattgagatgtaatgaattgatgttgacgatcaaggatgtttaataattcttgatccttacagaattgtctcagcatcataaactgatctagcacagtaagtgttccggaaagcacctcatgcatatcaaacatttcatgtccgccatggtttttatgcggtttgccaggaatacctttgttcatttgggattgctgctgctgattgaactgatccaaaccgaattcctcctttttttttcagatcagctgtattttgtgtcagtctgccgcttattatgcagaagtctgaaaggaattatatgctgtctgtcgaaatgatagacagacaaagtcattgtcattatgtgtatattaagggaggaaatatgatgaggcgtattctgcatattgtgttgatcacggcattgatgttcttaaatgtaatgtacacgttcgaagctgtaaaggcagctgaaccgcaacagcctatatcgattgagaaggcaatacagcaaaaagaaggacaggcgcttatcgaaggatatgcagtcggccaggctgtttccccactgcattataagctgacaagccctttttcaaatgattataatgtcgcgctggcagaccgtaaaaacgagacatcgcctgatcacatccttcctgtgcaaatcccctccgccttcagaagccaatttgggctgcaaaccaatccgcttcttcttgggaaaaagataacggttcaaggaaaacttgataattactttaacacgacaggacttaaaaacgttcagtcgatgaacgtaaccgatgacacgaaaactccgccggctgaacagcaagtgaccataaatgaagcacggggaaggctgaatgaagaagtaacgataaaagggatcattacagctgatcaaaacgcaatcggaggcgggaagctgtcgacctttttgcaagatgaaaccggaggcattaacatttattcgccatcccctgaacaatttcccgaattaaaagagggtatggatgtcacggtgacagggaaaatcacgtcttaccaggggctgaaagaaatcgttccaagctcatcaggcatcaaaatcaaccagtcaaaccaatccctccccgcccccaaacacttaacaatcaatgaacttattaacggcagcctaggtgatcagtatgaaggacgccttgtgaaactaaccgcttttgtttcctcaattccaagttctcctgccggcggcggttacaatgtaacaatgattgatgacgaccatcatgcaatgacgctccgggttatgaatgaaacaggggtgatagacgagcttgatgagggcaaatggtatgactttaccggtgtgttaagcagataccaaacctttcagctgcttccgcgaaaatcggctgacctgaagctgcttgaagagcagcctgcacctccgtctgcggagggagaatatgaagggattgttgaccgggtcgttgacggcgataccattcatctcaaatctccggtgcttggaacgacaaaaatccggtttgtaaatgtagatacacccgaaacatatcacacacctaaaaatgacgcagatgaaaatcaattaagatttggcaaaaaagcatctgactatctaaaaacggttctgtccccaggtgataaaattactgtaaaggtaggaagtgaagccaaggacagctatggcagacttctcggacaagtcataaccgaatcaggatcaaacgtgaacttagagcttgtgaaaaatggatatgctccgacgtattttatttggcctgttgacaatgaagaggattatcagcagtttcaggccgcagtagccactgcaaaaaaagaccaaaaaggaatctggaatgaaaacgatccgctcatggaaatgccgtttgaattcagagccagagagcaaaggaaaggcttgacaagatatgtaggggattcgtcgaataaaacatatgtgcagccagctgactggaagaaggtagctgttgaaaacagaattttcttcgcttcagcaagtgaagcggagagcgcgggatataaaaaaaggcaaacggcacctcaagaacatgtgccgcttagaattctcagcatgaatgatttgcatggcaaaattgatcagcaatatgagcttgatcttgatggaaatggaactgtagacggcacgtttggacgcatggattatgccgccgcatatttaaaagaaaaaaaggctgaaaagaaaaactcgctgattgtgcacgcgggagatatgatcggcggaagctctccagtttcctctcttcttcaggatgaaccgactgtagaactgatggaggacatcggatttgatgtcggaaccgtgggaaaccacgaatttgatgaaggcacggatgaactgctgaggatcttaaatggcggtgatcatccgaaaggcacaagcggttatgatggacagaactttccccttgtatgtgccaattgtaaaatgaaatcaactggagagccctttttgccggcttatgacatcataaatgtggagggcgtacccgttgcttttatcggagttgtcacacagtcggcagctggcatggttatgcctgaaggaataaaaaatatcgagtttacagatgaagcaacagcggtgaataaggcggccaaagagctgaagaaaaaaggcgtgaaggccatcgcggttctcgcacatatgtcagctgaacaaaacggcaacgccattaccggtgagtccgctgatcttgcaaacaaaacagattctgaaattgacgtgatttttgccgcgcataatcatcaggttgttaacggtgaagtgaatggaaaactgattgttcaagcgtttgaatatggaaaagcgataggtgtcgttgatgtagagatcgataaaacgacaaaagacattgtcaaaaagtccgcggaaatcgtatatgttgatcaaagtaaaatcgaactggatgtcagcgcgtcagccattttaaagaaatacgaaacaattgcggaaccgattatcagcgaggtagtcggcgaagccgctgttgatatggaaggggggtattcaaatgacggcgatacacctcttggaaacctgattgcggatggtatgagaactgccatgaaaacggattttgcccttatgaatggcggcggcatacgtgaagcgttgaagaagggcccaattacgtggggagatctttacaatattcagccatttggaaatgtgttaacgaagcttgagattaaaggaaaagatttaagagagattatcaatgctcaaatctcgccggtttttgggcctgactacagcatcagcgggtttacgtatacgtgggataaagaaaccggaaaagcagttgatatgaaaatggcagatggcaccgagatccagcccgatgccacatatacattgactgtcaacaactttatggcgacggcgacagggaccaaatatcagccaatcggactgctgggaaaaaatccggtgacagggcctgaggatttggaagcgacagttgagtacgtgaagagttttgatgagccaattgcgtatacaaaagagggaagaattaagcttgctgaagccagtgatattgaagaccctgtaacagaagaccctattacggaagagcctggagatgatccggtgacggaggatccgattaaagaggatccaaggccaggtaaagatttgcctgatataaaagaaactccgggaacagcaccggttcatcagcttccgccttcagccatttcgagattcaatgaaataccaatcaacaacacaaaaaccgctgatactgctaatagcatcagcacattgccgttacgaaacgagggcggggaaagcgggtctgatcatcagcttccggatacatcagcaaactactataactttatgataatcggtgcggcggtgacattgtcaggaacttatctatatgtcagaagaaaaaggagcgcctccagaacgtgaaaaaaattattccactattcatcattgctgccggcctagtgatcgcaggctatggaggctttaaattgatcgatacgaatatgaaaacagaacagacactaaaagaagcaaaactggcggctgaaaagccgcaggaacttttggggacgaaaaatagcacagatcaagcaaagaacaaagcatcatttaagcctgagaccggccaagcgagcggcattttggaaataccgaaaatcaatgcagagcttccgatcgtggagggcaccgatgctgatgatttagaaaaaggtgtcgggcattacaaggacagctattatcctgatgaaaacggacaaattgtgctgtcggggcatcgggataccgtgtttcgccggacgggagagctggaaaagggggatcggctccgcattctcctgtcatatggagaattcacatatgaaattgtaaaaacaaaaattgtcgataaggatgacacatctattatcacgctccagcatgaaaaggaagagctgattctgacgacctgttatccgttttcatacgtcggaaatgccccgaagcgctatattatatatggaaaacgagtgacttaaaaagccgaggcagtgcctgcggcttttcttcatgaaaaatatgtgcggcaaaggtttttcatatcagcagggaaaggggcttcagcaactatgagctcgtctgttatcgggtgaaccgcttgtactttattggcgtgcagtgcctgcctgtttagcagcttgctcccgcctccgtaaagcgagtctcctgtcaacggatggccgaggctcgccagatgaacacggatttggtgtgttctgcctgtttccagctctaattcaacgagcgacagccgttctttcgcattgctggccattaccttgaaatgagtgacggctgtttgcccgcctggtgaaacccggcgtcttgtcgggtgtgatcggtctctgccgattggtgaattaattgtcccttttttcgtccgtagcttaccttcagcgatggcggtatacgtacgcttcagcgtctttttctctaactgctggtctaagatggcgtgtgccaaacgatgcttggcaaaaacgatagcgccagatgtatcctgatcaagacgatggacgtggcgcaccttacatgtttcgccatttatctgataatgataagcgatcaaattagccagtgtgccggtttgcccatcctcattcggatgcgtcgcgatgccagcgggtttattgacgatgagcatgtgattgtcctcaaataaaatatcaagctcgccatactccggaatgaccgaagatgcttcactttcctgaagatcaatgaacacgcggtctcccttttttacaatcatattgtttaagacggattcgtgattgacctttatctgttgatgggacatccagtcttgtatcactggtttagaagctttgagcgctgttttgagtacggaaaacagccattggccgtcctgtttttcattgatgaggatctcaagccctctgcctttttggttcatgttaaatggctccttttcgaagcggaaggctgctgtttctcataggaaacacttaccttagctttcgcgtttttttctgtgctattcttgagtaagacttaggatattcgatggcaagaaaggtgattgacgtgagaattgtgaacgcagcaactgcagaacaggagagctttatcaaggagctgactatggagctgatccatgatgtatttcctctttatttctccgaactggacattcagcgctttaaaaagaaaggcgttctgtctttaaataaccattattaccaaggaacattaaaagaagcatttcaaattatggcttgtctgcaaatgatacatattatcctgaccaagccttcgccgcactctgatttgagtgatcaggcgatttttgaaaaaaacagcaagatgctgaatgattttgggatttattttccgtttgctttttctgactttcaaaagaagactaacaaagcctttttcggtcaaagaaggctgatataatcatgcggcaagggcttttctattttcagaaaagctctttttgtatcagagaaatcatatcataaaacctttcctctaactccctttttaaacggctcgtgtctgaacatactaatgattgaaaggggtgctgacaaatgagttcagttaaagatacaatgacaacgcaggtggcaaccgtttctccgaatcaaacgattcaggaagcggcttctctaatgaaacagcataacgtcggggcgatccccgttgtagagcaaggtgttttaaaaggaatgctgactgaccgtgacattgcattaagaactacagctcagggccgtgatggccagacacccgtttcagaagtgatgtcaacagaactcgtatcaggaaaccctaatatgagtctggaagacgcgtcgcagctgatggcccagcaccaaatccgccgccttcctattgtagatcaaaacaatctagtcgggatcgttgcgcttggagacctggcagtcaatcagatgtcgaacgagtctgcgggatcagcgctgacaaacatttctcaccaaaacattcattaataagaaagagcttgcagtgtgcaggctctttcttcacataaaaccttactttttgaaagcggacttgtttcggggtatagtgagtgtatacatatgtctcaattcgtactaaaggagttgtacccagtgattaaagcgttaatttttgattttgacgggcttattctagatacagaaacacacgaatatgaggttcttcaggaaatatttgaagagcacggctcagtgctgccgctatctgtctggggaaaggtcatcggaactgctgcgggtttccggccttttgaatatttagaagagcagatcgggaaaaagctgaaccatgaagagctcacacaattgagaagagagcggttcgccaaacgcatggaaacagaaaaagcgagacctggtgtcgaagcgtatttgaatgcggcaaaggatttaggcttaaaaataggccttgcctccagctctgattataaatgggtgtccggccatttgaagcaaatcggcctgtttgatgattttgaagttattcaaacggctgatgatgtggaagaggtgaagccgaatcctgaactctatttattggcggcaaagaacctgggggtatcgccagcggaatgtctcgcgtttgaggattctgtcaatggttcgattgctgcgaaacgtgcaggaatgaagtgtgtcattgtcccgaataaagtaacgggcaccttgatgtttgaagactatgatcacaggcttgaatcaatggcggaaatggagctcgccctattgcttgatcatctgaactcacaaaactagaaaggagcgagtaggttgtctgagaaattagatttgacccggtttgaaaagaaaatggttatccgcaatatcgaagagaaagacatcgacaagattatcgatcttcaaaaggactgctttccggggatggaaccttggaagcgagagcatttaatcagccatttggagcattttccagacgggcagttttgtgcagaattcgaaggtgaaattatcggttcgtgctcaagtctcctgattaactttgatgaatatgatgaccgccatacgtggcaggacattacagatgacggttatatcaccaaccataatcctgacggcttgaatatgtacggaattgaagtcatggtgcacccgaaatacagacgaatgaagatcggccaccgtttgtacgaggcgagaaaggacttagccagacgcttaaacctgaaaagcatcatcataggcggacggattccaaactatcacaaatatgcagatgaaatgacagcgagagagtatgttgaacaggtgacacgccaccaaatatacgatccggttctttcttttcagctgatgaacggctttacccttatgcgaattaacccgaattatctcccagatgatacagcttcgatcaagtatgcgacgctgatggaatggaataatgtcgattatctaccgcagcagacaaaacgctattataaatcggcgttccctgttagaatttgtgtgatccaatacgaaatgaagaaaatttattcctttgaggaatttgcgaatcaagtagaatactatgtcgatgttgcttccgacgcaagatctgattttgcggtgttcccggaaattttcacaacccagctgatgtctttccttgaggaacggtcaccgagcttggcggtgcagagaattaccgagtatacagaagattacatcagcctgtttactgacttggctgtgaagtataacgtcaacattatcggcggatctcatttcgtcgaagaggaaggcaagatctataatatcgcttacctgttcagacgggacggaacaatcgaaaagcaatacaaactccatattacgccgaatgaacgcaaatggtgggggatcagcgcaggagaccaagttcgcgtgtttgatacggactgcgggaaaatcgcgatccagatctgttatgacattgaatttcctgagcttgcccggattgcggctgataaaggagccaaaatcatctttacgccattttgtacagaagaccgtcaaggctatctgcgtgtcagatactgttcgcaggctagagcggttgaaaatcaaatttatacggttatctctggaacggtcggaaaccttccgcaaacggaaaacatggatatccaatacgcccagtcaggcatctttgccccgtctgattttgaattcgcccgagacggcattgtcggcgaaacaaacccgaatattgaaatggttgtcatcggcgatgttgacctggaaattctcagaagacagcgccaaaacggtacagtgcgccagctaaaagacagacggcgtgatatttatcatattcaatataaaaaataatttccaaaaaacccgcctgaattggcgggttttttaaaacaaaagcggaattgtttaggtgctgtctttaaaataaaagtaggtatagtggaggtgccttatggagtttctgtattttcgccatttcctatatcatacagaaaacggctaggcttcacattgctattgcaatggctgtccaagttgtttcgagtgcgacctttatcagtacgatgctgagcattgccactttgcctgttttgctttggaagctgcatcctctttcttcttgagaaaggggatgttttattatttacgcggtttattgactctgacccggtctggctttatattgaaggcagggaaatcatcaccaagacatcacataaagagaaggtctgtttcaattgaattggcattatagggaacgctaatgaaatggagatgatggggatggaaaacattcagcaaaatcagggattaaagcaaaaagatgagcaatttgtgtggcatgccatgaagggagcgcatcaagcggacagcctgatagcccagaaggccgagggggcctgggtaaccgacatagacggacgccgctatttggatgcgatgtccggtttgtggtgcgtcaacattggttacggcagaaaggagcttgcggaggctgcctatgagcaactaaaggagctgccttactacccgttaacgcaaagtcacgcacccgcaattcaactggcggaaaagctgaatgaatggcttggcggcgattatgttatctttttttccaacagcggatcggaagcaaacgaaactgcttttaaaattgcccgccagtaccatctgcaaaacggcgaccacagccgttataaattcatctcaagatatcgggcataccacggcaatacattgggagcgctctcagctaccggacaggcgcagcggaaatataaatacgagcctttgagccaagggttcctgcatgcagctccgccagatatataccggaatcctgatgatgcagacacgcttgaaagcgcaaatgaaatcgaccgcatcatgacatgggaattaagcgaaacgattgccggggtcattatggagcccatcattacaggcggaggcatcctaatgccgccggacggatatatgaagaaggtggaggacatttgccggcgccacggagcccttttgatttgcgatgaagtgatctgcgggtttggacggacaggcgagccgttcgggtttatgcactacggtgtgaagcctgatatcattacgatggcaaagggaatcacaagcgcgtatctgccattgtcagcgactgctgtgaaacgggacattttcgaagcgtatcagggggaagctccttatgaccgtttccgccacgtaaacacgttcggcggaagcccggctgcctgtgctttggcgttgaaaaacctgcaaattatggaggacgaacagttgattcagcgatcccgcgatcttggagcaaagcttttaggtgagcttcaagctctgagagaacacccggcagtcggggatgttagaggaaaagggctgctgatcggaatcgaactcgtcaaagacaaattgactaaagagccggctgatgccgccaaagtaaaccaagtggttgcggcgtgcaaagaaaaagggctgatcatcggcaaaaacggcgatacagtcgccggctacaacaatgtcatccagcttgcgccgccattttgcctgacagaagaggacctttcctttatcgtgaaaacggtgaaagaaagctttcaaacgatataatataaaagtgaattattaaaggagcacatgatgagttttcacaaccagccgatcttaccggctattcgcaatatgaagcaatttgatgagtttttgaacagttcgttctcttacggtgttattcttgatattcatctcggccagctgaagggcgtgatcaaagaagcgcaaaagcacggaaagaacatgatggtgcacgtcgatctcattcaagggattaagcatgacgaatacggtgcggaatttatatgccaggatatcaagcccgctgggattatttccacaagatcgaacgtgattgccaaagcgaagcagaagaaaatttatgccattcagcgcctgtttttgcttgatacaagcgcgatggagaaaagcatggagtttatcggcaagcataagcctgacttcatcgaagtgcttcccggcatcgttccgtcactcattcaggaaataaaagagaaaacagggattcccatctttgccgggggtttcatccgtacggaagaggatgtagagcaggcattgaaagcgggggctgtagctgtcacaacgtctaataccaaattgtggaaaaaatatgaaaactttttgacggaaagtgattgacaccgctttcatgcactgatacaattgcactaggttaatacattgtgatggagaactcggagaccacagcagctctttacggcaaatgtttatgcacccgtaaagcggtttgttgtggtttttttattctcttcttctctatcatgctttttaatcgtgactttaggaggaatgtgctatgacagcattttggggagaagtcatcggtacgatgctgcttatcatttttggtgcaggtgtttgtgcaggtgtcaatttaaagaaatcgctttcattccagtctggctggattgttgttgtatttggatggggattgggtgttgccatggcggcatacgcggttggcggcatcagcggtgcccatttgaatccggcgctaacgatagcgcttgcatttgtaggagattttccttggaaagaggttccggtttatattgcggcgcaaatgatcggagcgatcatcggtgcggtgattatttatctgcattacctcccgcactggaagtcaacggatgatcccgctgccaagctgggtgttttctcaacagggcccagcattccgcatacatttgcaaacgttttaagcgaagtgattgggacatttgtccttgtacttggaatcttggccattggggcaaatcaatttacagaaggacttaatcctttaatcgtcggtttcctcattgtagcaatcggtatttctctgggaggcaccaccggctatgctatcaatcctgcacgtgacttaggtccgcggatagcccacgcttttcttccgattccggggaagggctcatcaaactggaaatacgcatgggttccggtagtcggcccgattttaggcggatcattcggcggcgtattttacaacgctgcatttaaagggcacatcacaagcagcttctggattgtaagcgttatattggttgtggtattgttaggactctatgtttatacgaaatcacattctgctaaaacattatcaaattctaaatatatttaatcaaaggggagacatcttatggaaacgtacattttatccttagatcaggggacgacaagttcaagagcgattctgtttaataaagaaggcaaaattgtccactctgctcaaaaggaatttacacaatacttcccgaatcctggctgggttgagcataatgccaatgaaatttggggctctgtcctcgcggttatcgcctcagtcatctctgaatcaggaatcagcgcttctcaaattgccggcatcggcatcacgaaccagcgcgagacgacggttgtgtgggataaagatacaggaagtcctgtctataatgcaatcgtttggcagtccagacagacgtccggcatttgtgaggaacttcgtgaaaaagggtataatgataaattcagagaaaaaactgggcttttaatcgatccatacttctccggcacgaaggtgaagtggattttagacaatgtggaaggcgcaagagaaaaagcggaaaaaggcgagctgctgtttggaacgattgatacgtggctcatttggaaaatgtcaggcggaaaagcgcatgtgaccgattactccaatgcctcaagaacactgatgtttaatatttacgatttaaaatgggacgatgaactgctcgacattctaggcgtaccgaaatccatgctccctgaagtgaagccgtcctctcatgtgtatgcggagactgttgattatcacttcttcggaaaaaatatcccgattgctggagcggcaggcgaccagcagtccgcattgttcggccaggcatgctttgaagaaggcatggggaaaaacacttacggcacaggatgtttcatgctgatgaataccggggaaaaagcaattaagtccgaacatgggcttttgacaacaattgcttggggcattgacggaaaagtgaactatgcgttagaaggaagcatttttgtcgctggctctgctatccagtggcttagagacggattgagaatgttccaggactcttcgcttagcgaatcttatgcagagaaagtggattcaactgacggcgtatatgtcgttccggcctttgtcggactgggaacgccttactgggacagcgatgtgcgcggttcggttttcggcctgacaagagggacaacaaaagagcactttatccgtgcgacactggagtcattggcttatcagaccaaagatgtgcttgacgcaatggaagcagattcaaacatttcattaaagacgcttcgtgtagacggaggagctgtaaaaaacaatttcctaatgcagttccaaggagacctgttgaatgttcctgtggagcgcccggaaattaatgaaacgactgcacttggcgcggcttatttggcaggtatcgctgtgggattctggaaggaccgttctgagatcgcgaaccagtggaatctggataaacggtttgagcctgaattggaagaagaaaaacgaaatgagctgtataaaggctggcaaaaagccgtgaaagcagctatggcttttaaataaagtaatactatggtataatggttacaagttaataagaacggtcctgagatgaggagagaccacagcaccaaagtgtaagcatgcactttggctgttgtggtctctttttctatttaccgtgacaacaaggaggagacgtaatgatgaaacatcaattttcaagtcttgaaagagatcgcatgctgacagacatgacgaaaaaaacatatgacctatttattatcggaggaggaattacaggagccggaacagctcttgacgcggcatcaaggggaatgaaggtcgcactaagcgaaatgcaggactttgcggcgggaacatcaagccgatcaacgaagctggtacatggcggcttgcgctatttaaaacaatttgaagtgaaaatggtcgctgaggtaggaaaagagcgggcgattgtgtatgaaaacggcccgcatgtcactacaccggaatggatgctgcttccgtttcataaaggcggcacattcggttcatttacaacatcaatcgggttaagggtttatgacttccttgcaggtgtgaaaaagtcagaacgaagaagcatgctttcagcaaaagaaacgctgcaaaaagaacctttggtaaaaaaagacggcttaaaaggcggcgggtactatgtggaataccgcactgacgatgcgagactgaccatcgaagtcatgaaggaagcggtgaaattcggggcagagcctgtgaattactccaaagtgaaggagcttctttacgaaaaaggcaaagccgtcggcgtattaattgaagatgtgctgacaaagaaagaatataaagtgtatgcgaaaaaaattgtcaatgctacaggcccttgggtcgatcagctcagagaaaaagaccattcgaaaaacggaaagcacttgcagcatacaaaaggcattcaccttgtatttgaccagtctgtctttccgctgaaacaggctgtatatttcgatacacctgatggccggatggtatttgcgattcctcgtgaaggcaaaacatacgtgggaacaacagacactgtttacaaagaggcgctggagcatccgcggatgacaacggaggatcgtgattatgtcatcaaatcaatcaattacatgttcccggaactgaatatcactgcgaatgacatcgaatccagctgggcggggctgcgtccgctgattcatgaagaaggcaaagatccttctgaaatttcacggaaagacgagatttggacatctgactcaggcctgatcaccattgccggcggaaaactgactggatacagaaaaatggcggagcacatcgttgatcttgtccgtgatcgcttaaaagaagagggcgaaaaggattttggaccatgtaaaacgaaaaacatgccaatctctggcgggcacgtcggcggttcaaaaaatcttatgtccttcgttaccgcgaaaacaaaagaaggaattgcagccggtttatcagaaaaagacgcaaaacagcttgcgatcagatacggctctaacgtagatcgtgtctttgaccgggtagaagcgctgaaagatgaggccgcgaaacgcaacattccggttcatattcttgctgaggcagaatacagtatagaagaagagatgactgcaacccctgctgacttctttgtccgcagaacgggacgtttattttttgatatcaattgggtaagaacatataaagatgccgttattgattttatgagcgagcgattccaatgggatgagcaggcgaaaaacaaacatacagaaaacctcaacaagcttttacacgatgcggtcgtaccgcttgagcaataaatcataacgggctgtctgcagcccgttatttctttttacgtgccgaaagggccagatctcaggttatcaagtgacagaggcacccgattcatataaaataatggcataagctgatacataggaggacgaatatgacttggagaaagagctatgaacgctggaaacagacagaacatttagacccggaattaaaagagcgccttattgaattagaggggaatgaacaggcccttgaggactgtttctataaagaccttgaattcggtaccggcggaatgcgcggggaaatcggcgccgggacaaatcggatgaatatttacactgtgcgcaaagcatcggccgggtttgcggcatacatctcgaagcaaggtgaggaagcaaaaaaacggggcgttgtcattgcttatgattcccgccataaatctccggagttcgcgatggaagcggcaaaaacacttgcgacacaaggcattcaaacatacgtgtttgatgagcttcgcccgacgccagagctgtcattcgctgtcagacagctgaacgcttatgggggaattgtggtaacggcaagccataacccgcctgaatataacggctacaaagtatacggggatgatggcggccagctgcctccaaaggaagcggacatcgtcattgagcaggtaaacgcgattgaaaatgagttgacgatcacagtggacgaagaaaataagttaaaagaaaaaggcttaatcaaaatcatcggtgaagatattgataaagtttatacagaaaaactgacgtcgatttctgtacatcctgaattatcggaagaagtagatgtaaaggttgttttcacaccgctgcatggaactgcaaataaaccggtcagacgcggacttgaagcactcggctacaaaaatgtaacggttgtcaaagaacaggaactgccggattcaaacttctccactgttacatcgccaaaccccgaagagcatgcggcattcgaatatgccattaagcatggggaggagcagaatgcagatattctcatcgcgacagatcctgatgctgaccgcctcggcatcgcggtgaaaaacgatcaaggcaaatatacagtgctgacaggaaaccaaaccggagcgctgctgcttcattacctgctttctgaaaagaaaaaacaaggcatcctgcctgataatggtgttgttctcaaaacgatcgtcacaagcgaaatcggccgtgctgtagcttcttcattcggccttgatacgattgatacgctgacaggctttaagtttatcggtgaaaagattaaggaatacgaggcatcaggccagtataccttccaattcggttatgaagagagctacggttatttaatcggggattttgcccgcgataaggacgccattcaggctgcgcttttggcagttgaagtttgcgcgttctataaaaaacagggaatgtcattgtatgaggcgctcatcaatctctttaacgagtatggtttttatcgtgaagggctgaaatccctgacgctgaaaggcaaacaaggagcagagcaaattgaagcgattcttgcttccttcagacaaaatccgccgcagaaaatggcgggcaaacaggttgtcacagcagaagattacgctgtaagcacacggacgcttctgactgaaaacaaagaagaagctatcgacttgccaaaatcaaatgtactgaaatacttcctggaagacgggtcttggttctgtcttcgtccttctggaactgagccgaaggtgaaattttatttcgccgtaaaagggtcatctttggaagacagtgaaaagcgacttgccgtcctttctgaagatgtaatgaagacggttgatgaaattgttgagtcgacggcaaaataattcaagtatgagctgggtcattgtaaatgatccagctttttctttttctcatccaaaagtctgaaagaaaatcatcccatcagtgaagtaatgaaatacaaaaaactggtataatcttaaatacaagatcaatgccggagtgagaaacgtgagcaaaacgaggatggaaaaattaaaaacgctgaaaacgattgcggaaaccttaaatcaagggcacgatatcaaagcaacactggatgaggttttaaaagagttgttgagtctgacaaaccttcaatccggatggatttttctgatcgaagaagatgggtcttatacgttagcggccgacgcttatctgcccccggctttaagccgcaaggaaaaagtgctgatgtgcgaaggggagtgttactgcctgacgaaattcaataacggagggcttagaaaggctgcaaatatcatgaactgcaaacgcatcgaatcagcagaaaacctgcattgttttgacacagaagggattacgcatcatgcaactgtgcctttagaagacggggacagaagattcggattgttaaatgtagcggcggccggaaaaaccatgtttgatgaggaagagctgcatttactcgagtctgtcgcctttcagatcggaacggcaatccagcgtatgaggctttctgaatatcaacaaaaaaatgctcttttaatggagcgcaaccgcctcgctcaggagcttcacgattcagtcaatcaaatgctgttttccgtcagtttaactgccaaagctgcgaagacactaacaaaagatgaaaatttacagcagatgattgatttcatccaaaacctatcacaggacgcgctcgcagaaatgaaagcgttaatttggcagcttcgccccggaggattggaaaaagggctggctgaagccattaaaagctatggtgcgctcattggattgaagatcatttttacacaaaaaggctgtcctgttctgactgatgagcaggagcatatgctatggcgtgtcgtccaggaagctttaaataactgcaaaaagcatgccggaacggatacggcgtatgttagtctgactgcttctttgtgccatgcggagctggatatcatcgatcatggggcaggatttcgctatgaagcgcatgccgatctgccttcacttggcatcaagggtatgaaagaacgagcggaaaaagccggagctaagttttggattgagtcagcgcttggaactggaacaaagctgtccatcaggcttccgctaacaagccgaaaaggaggggcggtatgaaaattgtcattgctgatgatcatcatgttgtcagaaagggtctgcgttttttctttgccacccaggatgatattgaagttgtcggagaagctgcaacgggaatagaagctctccgtgtcatcgaagagacaaagccggatcttgtgctaatggatctgtctatgcccgagatggacggcattcaagccattaaaaaagcaatacagcaatttccggagacgaatatcattgtgctgacgagctactctgaccaggagtacgtcatccccgcgcttcaggcaggcgcgaaggcgtatcaattaaaggatacggagcccgaggaattggtgaaaacactaagacaagtgcatggtggcgaatacaagctttctacagctattatgccccatgtgctgacacatatgaaaaatcagcacgacccggaaaaagaaaaatactatcaattaactagaagggaaaaagacgttctgactgaaatagcgaacgggaaaagcaataaagaaatcgcagcagccttgtttatttcagaaaaaacagtaaaaacccatgtatcgaatcttttagcaaaacttgaagtggccgaccgcacgcaagcagcgcttttcgcagtgaaatataacctgaatggagagatctcaaaatgaacatgttagtcataaatggcacgccaagaaaacatggcagaacaagaattgcagcatcctatattgcagctctgtatcacacggatttgattgatctaagcgagtttgtattgccggtttttaacggtgaagcggatcaatctgaactgttgaaggtacaggagcttaagcaacgcgttacgaaagcggatgcgattgtattattatcgcctgaatatcacagcggcatgagcggcgctttaaaaaatgccttggattttctaagcaacgaacaattcaaatataagcccgttgcattattggcagtagcgggaggcggaaaaggcggcatcaatgcgctgaacaatatgagaactgtgatgcggggtgtctacgccaatgtcatcccaaagcagctggtgcttgatccggtgcatattgatgttgaaaatgctacagtggctgaaaacattaaggaaagcataaaagagcttgtcgaagaactcagcatgttcgcaaaaacaggaaatcccggcgtctaaacgccgggatttgtttatgtgagaagggctatttgatcttcataagtcagctctgtggcatgatcaatataacggagaagggaatacagcatcttttctaaaacggcgtaatcctgttcaaaatgatacgcatgcagaaaatgctcaattcgttttgataacaaatcgtcctctgtacgcaccattaaaattaataaattatcccattgagaacgatgggtgtaataaagcgctttatcgtaatcggcataatccatgaatcgcttctcctttcttgggtgagaagttcatgattagtttatgccgcatcctctgttattgacggggcaaaacttggcgtctgcggcagtaaaggggtagcaatatgagggagacataaaatcaaaatgcctgaatgaagatatcgcttttggtaaacctatgagggaacatattctgggtacaggagactgaaaaaatgaaatccctgccgtataccatcgcgcttcttttttgcggattgattatcgtgtcaatggctgcaaaaggtcattcaacggacacagacgagtccgttcaaaagtgggaacagcttgcctggagcaaaattcaggatgaatataagggcgcttcattttctgattatgcttatatggggcgtacagaggtgaatgatcagcagacgaaagatgtctttcgggtgacagtcagacagaaagatgacactttttctgttcgggccgaagtctattttcatccggtgacaaatcatatgatcagcatcaacgtctttaggctctaataaaaaactgtacagccgttaaggccgcacagtttctgtttttagaaatatcgttttgcaccgagatagcgctgtttccagtaagagttgttcatattggaaatgacaactccggaatcgttggcatttatgaattccccgttgcctaggtaaattccgacgtgggaagggccggctttatatgttgtaaagaaaacgaaatctccgacagcaggctggctaactgatttcattgtgttccaatatcccgctgccgttaatctagatacggatgtgactttgttcagtacatagtaaatgaatccgctgcagtcaaacccggacggtgtcgtgcctccccagcgatacggaaccccaagctgcgctttagcggccgaaatcattgtgttaatcttcgcactcgttgagctggtggtgtttgaagaaccggatgaagacgatgatgaagcttttccggaaatgaccagcttttggccaacctgcaagacatccgtttttaaattgtttttctcacgaatctgctgagctgttacattaaatttttgagcaatcacccataaggaatcaccgcttttcactgtgtatgtagtcgtcgtgcctgagcttgcatttgacgaagaagacgacgatgatgaagagcctgaagatgctttacctgtcagcttcaatacttgtccaacgtacagcacatctgatttcagattgttgatatttcggatttgctgtacagacaggttatagttgtttgcgattttccaaagtgaatcaccgcttttaacggtatatttagttgttgctgaagtttggttcgatttggatgaagtgtctttagaagacgtatcagagccgcttgattttgttttcaacacctgattcacgtaaatggtgtctgattttaagttgttcaagaccttcaattcagcgatggacatattgactttgtttgcaattttccagagtgaatctccaagctgcaccttatatgttcccgtagaagatgaggaacttgaactcttattagaactgctttttgaactggagcttgaactcttattggaactgctttttgtactggaacttgaagaaacagtaccggacacctttaatttctgcccagcacgaattaaatcgctgcttagtccgtttaattttttcagttcctgcaccgtcattttaaactcatttgcgatcagccaaagtgaatctccgcttttcactgtgtaaacagaacttccgctcttcttggttgttgagcttgaagtagatgaagaagtgctggatttgctgcctggaatagtaagcgtctggccgatcgacagaacagtagtcgaaagatgattggcggatgtgagggccgccacacttgtgttataggtttgggccagtttccataaagaatctccgcttttgaccttaatcgttgctgcttcagctggtgtcactgctaaagttgtgccgacaatcgcagatgctgtcagccctgctgctaatttctttttcatcttagctctcctttttcccccaatgattttgcatttgctgtttcttttttatatcggcacatttgtctcatcgttttgcctttttataaaaatagccaaattatcttaacaataagggggaaaaagggcataaaaaagaaggaatcttgatctattccttcatttttaaaagcttcatgatatcttctttgtttttgacgaggtcgcgcagtgtgtatttgtctaaaactgcgaggtaggccaaaagcgcttcattcagcacatgttttaagccgcaaaccggggaaataacacagagattcttattcgcatcaaaacattcaacaatattaaaatcgtcctccgtttttctgacaacctcaccgatgttgatgtcttcaggttccatgcctaatcgtatgccgccgccccgtccgcgtatcgtttctacgtagccgagctggccgagcctgtatatgactttcatgagatgattttttgaaatagaatacgtttcggcaatctgttttatatttgaaagttctccgggacgctctgcagccagaaaaatcaacactcttaatgaataatctgtataattggttaacttcataataagacctcagaataagacattttctatatcttatcataatcgattgaaaaatgaaaaaaaaggaattaaaaaaacatgcacccagctgggtgcatgttttttgcttacatgtcattcggcggattttggttttttcggtttttttcgatttctgtgttttgcattttgcgttcaaatgtagacagataacgtgatgcaaaatccttaccgccaaggccgaaggataaaccgaaagcgagtgcgaagccgctaagaacgatgatgaacgcggaattgacgattgtcgcagcgacaccaagctgatccagggccataaagaaagcaagtgcgataatcgtatatttagcaataggcgctaaagacttgaattcctggccttttatcatgcttgcgagcacttttctcaccaattctcctgcgtaaaggccgagtccgagaatgaatacggcgacaaggacattcggcagatacgcgatgatgccagtggcaatttctacgaggaagtgcagccgaacaatttgaagcgcctcagctgtaaagagcagaatgacaatgatttgcgcaatcataccgacaacttgagacaaggacagctttgcaggcgttccggcttccatgcccattttccctaagacagaatcaaagcctgcgcgatggagcagtccggacaccatggatttcacccattttcctgcccagatacccgctaaaacaagcacgatggcaatcatgatgttcggaagcatgtttaaaatcgtattcagcatagagacagctggctttgaaatgccggcgacatccagctgatcaagcgctgaaatgaccaccggaatcataatcagcacataagcgattgttccgatgactgctgaaaggcttgtgtcttttaagtaaattgataaacccatacgtgccgcgaatctttccgtgccgatgcttgcaaggaaattcgtaatgatatcacggacaaggcgggcaacaagccagccgattaatacgataagcgccgctgcaaataatttcggcagaaaagcgagcacgctttccatcatatttgtaaaaggacctgaaatgccgctgattttcaaagaagataagacccctggcagaaaaacaagcagcacgagataaaagacaatttgtgaagcggtattgacagcctggtgaatatcttttccttcagacaccaaattccacttgcgcagtttgtcactcgtgttcagcttcatcccgatttttttgacaaggaagcttaaaacagaggctgcagcccatcctaccagcagaatgagtccagctttcagcacgcttgggatcgcggctgcaatcgccgaaagcatactgacaaacggcgatgccactgttgtcaggtgcaaaatgttaaagaataaaataaagacgatgatcagtgcgataaaataaacgaccttgcttatgactttttccgaggaatagcgtgaaggctttttcccagcaaagagcttgtcgtcgatttttgttttgctgagtcctttgtataccgctttttcaatgattttagcaatagcccagccgattaataagacgagtaaagcaatgattacgtttggcagcttactgagataagaagaaaacacgtctgctacattcaattggtatcgctcctttttcgtagtatggtgtgtgtttacccacttatccaataagcaaacagatgaatgtgccgggggaattttttcttgcccgagtgagactatcatcttttgtctggcgggctcatacattatagataagtccaagtaggggggattcggttgaacgcggaggagaagaagggattacagcgggcaattgaggaaattaccgaaattgcaaaaggattcggccttgatttctacccgatgagatatgaaatctgcccggctgaaattatttatacatttggcgcgtacgggatgccgacaagattcagccactggagcttcggcaagcagtttcacaagatgaagctgcactatgatctagggttaagtaagatctatgagctggtcattaactcagatccatgctacgcttttttgctggacagcaactcactgatccaaaataaattgattgtcgcacacgttcttgctcattgcgatttcttcaaaaacaactgccgtttccaaaacacgaagcgcgatatggtggaaagcatggcggcaacagctgaacggataaaacactatgaacaggttcacgggataaaagaagtcgaatcttttttagatgcaatcctttcgattcaggagcatatcgatccgtcgttggtccgaccaaagctccaatggagtgtggatgatgaggaagaggagattgaagaggcagccacgccttacgatgatctatggtcattggatgaaaagaaaccgaaaaaacaagtgaaaaaatcgaaaaaaccgttcccgccgcggcctgaaaaagatatcctgctttttatcgaggagcattcccgggagctggagccatggcagcgtgatatattaacgatgatgagagaggaaatgctttatttctggcctcagctggaaaccaagattatgaatgagggctgggcttcctattggcaccagcgaattatacgtgagcttgatttaacctctgatgaagcgatcgagttcgccaagctgaatgcaggtgtcgttcagccgtccaaaacaggcattaatccttattatttagggctaaaaatatttgaagacattgaggagaggtacaacaacccgacggaggaaatgaagaaaatgggcgtgcagcctgactccggccgggagaaaatgtttgaggtcagggagattgaatccgatatctctttcatccgcaattatttaaccaaagaattagtcatgcgcgaggatctttatttgtttcaaaaacagggccgagattataaaatcatcgataaacagtggaagtcggtgcgcgaccagctcgtaagcatgcgggtaaatggcggttttccatatttgacagtaaacgatggcgattatatgaaaaataacgagctctatattaagcattggtatgaaggaatagagttagatttgaaatatttggagaaagtgctcccttatttattccagctttggggaagaagcgtgcacattgagtctgtgcttgaggataaggaagtcatgttttcgtacgacggaaaaggtgttcaccgcagatatttataaaaaagaggatgcagcgttctgcatcctttttattttccagtttttaaaatcttaaatatgatgtttgcctggtccgtattgttaatcaatccgcggaatttttcttttccggggccgtacgcgtataccggtacttcttcgccggtatgatcggtactcgtccatccgctgttggagcgagtattaaaaatcttgatgatggctttgtaggcccctttgcttttgtcagcctgtgcagctgcttcaacgcttttgatttcttcagatgtgactttcagattgccatagcgggcgagcacatctttaaccggcttgccttcactgatttttttggccatgaattcaggtgttttcttagcggagagaatcggttctgcgtgccaatttttttccccgtttgcgccaatggtaaagccgccggttgtatggtcagcagttgcaatcacaagtgtatgtttgtcttttttcgcaaattcaatcgcggctttataggcctgttcaaaatctttaacctcgctcatggctcctactgtatcattgtcatgggccgcccagtcaatctggctcccttcgaccatcaagaaaaatccttttttattttggttcaggcgatcaattgctgaaaccgtcatgtctttgagagacggtgttttgctgtcacggtcgagcgccttagcaagccctccctctgcgaaaagcccgagcacctgctgatctttatttttcttcaatgcttgtttagttgtcacatagctgtagccggcttgtttgaattcctttgtcaagtttctgtccttgcggttaaaataagattttccgccgccgagcagcacgtctattttatgtttgccttttattttgtcatccatatagctgttggcgatttggtccatgtttttccgtgattcattgtgggcgccatatgcggctggagtggcgtggttaatttcagacgtggcgacaagccctgttgacttgccttgctgtttggcctcttcaagtacagatttcacttttttcccgtttttatcgacgccaattgcattgttatatgtcttaacgcctgtcgctaatgctgttccggctgctgctgaatctgtaatattatagtcagggtcatccggatgcgtcatcatcatgcctgtcaggttccggtcaaattctgttaacttcgggttattcggtgtgtcaccgttatttttcatggaacggtaggctcttatgtaaggcgtccccatgccgtcgcctatcatcacaatgacatttctgatctcagctttgtcttgttttttggcgctggccttttctgtttgctgcagctcagctccggcaaagactccagctgtaaggacagaaacagcggcgattggcagaagttttgatttcatattttgaaacaaactcatttttttcatgcctcctttaatgtattccgtttatcatgttagggaaattttgttaaatgcggctgttgatcatgtaaacaataagtaaagtcttgtaaggaaatgaaaaaacgcttttcgttatcttgccttatttgatgtaaagcattcatttttcagaaaaatctttacctctctgtctttgcatgatatgtttgtttaaataaaaaaactgcggataaccgcaactctcctcgaatattctttatcactcatttttccggtatgtgagccgaccccgaaagtttttcatttatttcctttatgttgaaaaacatcccataaaacatgacaaaagcactcgttttttgtcacctttgcaacgaaaatgaaatatttaatacccttaaaaacttttttttagaacgaataattaagaaatttgtcacatgaagtcaagactatttctgatgggaatctatccttataatagaaatcaataagattaattaaaaaagagatacatatatagagagttaacatttggggaggaaaatatgaaaaagcaaatcattacagctacgacagcagttgttttaggatcgacgttatttgcaggagcggcatctgcacaaagcattaaggtgaaaaaaggcgacacgttatgggatctttcaagaaaatacgacacaacgatcagtaaaattaaatcagagaaccaccttcgttcagatattatttatgtgggacaaactttatcgattaacggcaaatctacaagttcaaaaagcagcagttcttcttcctcttcttctacatacaaagtaaagagcggggacagcctttggaaaatttcaaaaaaatacggcatgacaatcaatgaactgaagaagctgaatggcttaaaatcagatttgcttcgtgttggacaagtcctgaaactgaaaggttcaactagttcaagcagctccagctcatcaaaagtgtcatcgtcttcaacttctacttataaagtgaagagcggagacagcctttctaaaattgcgagcaaatacggcactacggttagcaaattaaaaagcttaaacggcttaaaatcagatgtaatctatgtcaaccaagtattgaaggtgaaaggaacaagcacaagcagctcaaaacctgcttcatcttcatcgtcttcaagcagcaaaacgtcatctacatcacttaatgtgagcaagctggtttctgatgcaaaagcgttagtcggaacgccatacaaatggggcggaacgacaacttccggctttgactgcagcggattcatttggtacgtactgaataaacaaacaagtgtgggcagaacaagcactgcaggatactggagttctatgaagagcattgccagcccgtctgttggtgatttcgtcttcttcacaacatataaatccggcccttctcacatggggatttacattggaaacaacagtttcattcatgcaggatctgacggcgtacaaatcagcagcctgaacaacagctactggaagcctcgttacctcggtgcgaaaagattctaatttttagagaaaacccgttcattggaacgggtttttttcattagacggagcacaggcgttttggttgctcctaaaaatgaaaatgtgataaaaaatccaagaattttttttctttcttattttcataaagggcaatcgcgtaagcgccggcatagggtagctgtacagactgataaggaattctgatcatctgtttctctgctaattcacgctttactgtagataaaggcagaaatgaaactccgagtccttccttgataaaccgtttcgttatatgtgtttgagtgaccttcattgttctcacaaatggaaaagtcattctgactggacggagcaagtcgtcccagtaatcaggatgattgtgggtcaaaagcaggtattgttcgagcacctctttggcatcaatttcgttgtcttctatgaaacgcttatcgggcggggcaacaaggacgacagggtctttgtataagcagtggcagcttaaagaagaagactgtacctttaaacagcttagtccgatatctgcttccccggctttaatcagtgacgcgatttccgctgattcgaaaatcgtaaccgccatttctgtttccgtattcattgctgtgtaccgcttcatgacagaaggaagcacagtatctgcaataagcggagaaaccgcgagctgtaaggtttgagagtagccttgtctcactctgtgaagctctgccatgctgttttcataatcatcaagaagcctgagcgcatacggcaaatacgccctgccttcatcagtcagctggatttgcctgcctttacgctcgaacagcttgcagctgatttctttttctaattgcttgatatgtacggtcacagtaggctgagataagaaaagcgtttccgccgtttttcggaagttttcatattttgcagcggtcacaaaggtgtgaagccatttgaaatccatttctattctccctctgattaatatttttaattaattccctttaaaatattcattattttttaaatattatatttactataataacagaaaaggatagggggaatacaaatggtacattacggattaaagggaattacatgtgtggaaacatccatcagccatattgatggtgaaaaagggcgtctgatttacagaggacatcatgcaaaagacatcgcactgaatcacagctttgaagaagcggcttatttgattttatttggaaaactgccttcaactgaagaattgcaggtatttaaagataagctggctgcggaacggaatcttccggaacatattgagcgcttgattcaatcactgccaaacaacatggacgatatgtcggtgctgagaacggttgtttcagcattgggggaaaatacgtacacattccatccgaaaacagaagaagcaatccggctgattgcaatcacgccttccatcattgcatacagaaaaagatggacgcgcggtgaacaagcaattgcaccttcttcccagtacggacatgtcgaaaactactattatatgctcacaggcgaacagccttcagaggcaaaaaagaaagcgcttgaaacctatatgattctggccatggagcacggcatgaacgcatcgactttttcggcacgagtcacgttatcaacagagagtgatttagtgtcagccgtcacggctgctctcggcacgatgaaaggtccgcttcacggaggcgctccttctgcggtgacaaaaatgcttgaagacattggagaaaaagaacatgctgaagcatatctgaaagaaaaactcgaaaaaggagagcgcttgatgggattcggccacagggtgtacaaaacaaaagacccgcgggcagaagctttgagacagaaagcagaacaggtggccggcaatgaccgtgatcttgatcttgcgctgcatgtagaagcagaagcgattcgtttactagaaatctacaaaccgggacgaaagctgtacacaaatgttgaattttacgcggctgcagtgatgaaggccatcgattttgacgatgagttgtttactccgaccttttcagcaagccgaatggtagggtggtgcgcccatgtgctggaacaggcagaaaacaacatgattttccgcccgtcagcgcaatataccggtgccattcccgaggaagttctttcataacatattttggcgttttaacgttcagtatcaaccacatgtctaggagtgatgaatgtgaacccaatggacagacaaacagaaggacaagaaccgcagcatcaggacagacagccgggcattgagtcaaaaatgaatccgctgccgctgtcagaggacgaggattatcgaggaagcggaaaactgaaaggaaaagtcgcgatcattactggaggcgacagcggaatagggagagcagcagctattgcctttgctaaagagggggctgatatctccttctatacttagacgagcattcggacgcagaggaaacacgcaaacggatcgaaaaggagaatgtccgctgcctgcttatcccgggagatgttggggacgagaaccattgtgaacaagctgtggagcaaacagtcgaccattttggtaaactcgatatcttagtgaacaacgccgctgaacagcatccccaggacagcattctcaatatttcaacagaacagctggaaaaaacctttcgcacaaatattttttccatgtttcatatgacgaagaaagctttgcctcacctgcaagaggggagtgccattattaatacgacatcgattaccgcttatgaaggggatacggcgttaattgattattccagcacaaagggtgcgattgtttcctttacgcgttccatggcgaagtcgctcgcagataaaggcatcagagtgaatgcggtggcgcccggtccgatttggacaccgcttattccggcgacattccctgaggaaaaagtgaaacagcacggcttggataccccaatgggaagaccgggacagccggttgagcatgcaggcgcctatgttctgctggcgtctgacgaatcttcctatatgacagggcagaccattcatgtgaatggcggacgttttatttcaacgtgatcaacgaaaaaccagctccagagctggtttttttgtgtggtgaaaaatttcaaaataaaaaatttgtcgatttttctaacaattttgttttcatttttgcaattttatatataatattgagtaggagaaaggaatgattcgcgaccagtacaaatatagtagaaaaaaagaaaaatgaccattgttgctcatgaattcagaaaattcaaataaaatatataaaaatagatgatcgggagttgaaggggaatgaaagggagcgtttttaggaagaagagcattcaggatttaatcgctgcgacgagcggtgaaaagtctttaaaaagagaattaggggcatttgatttaacattgcttggaatcggcgccattattggcacagggatttttgttctgacgggaacaggtgcagtcacggccggtcccgggctgacgatttcatttgttgtggcggcgctggcttgtttattcgccgccctgtcttacgcggaatttgcgtcaagtgtgcctgtttcaggttcggtgtatacattcacttatgcgacattgggagagcttatggcctttattatcgggtgggatttaattttagaatacatgctggcggtaagtgcagtgtcggtcggctggtctggttatttccaatcgtttttatcagggctcggcattcatcttccggttgctttaacagcggcaccgggcgcagtgaaaggcacctttaccctgtttaatcttcctgcattcgtcattgtaatggcgatcacatatttgctttatttaggcatcaaagaatcaaaaagagtcaacaatatcatggttatcttgaagatactggttgttctgctgtttatcgcggtggcagccgtttacgtgaagccgcacaactggcagccgtttatgccgatgggctttggcggcgtgttcagtgcagcggcgctcgtattctttgcttttatcggatttgacgctgtatcctctgctgcggaagagacgaaaaatcccgcgaaggatctgcctaaaggcattattttctctttactggtctgcacgattttatatgtcaccgtatcagctatcatgactggggttatcccgtttgctcaatttgcgggtgtggatcatccggtttctctagttcttcaaagcgcagggcaaaattgggtggcaggcatcattgatattggcgccgtgttgggaatgacaacagttatgctcgtgatgctttacgggcagacccgcgtcatgtttgccatgtcgcgtgacggacttttgccgggttcactttctaaagtgcatccaaagcacaaaacaccttatgtagccacttggtttttcggaacgatgtcggcgcttctcggctcacttgttccgctggatgaacttgcaaagctggtaaacatcgggacgctgtcggcatttgtactgatttctgtggcagttatcgttttgagaaagaaacagcctgatcttccgagagcctttaaatgcccgggagttcccgtgatcccaggcctggcgattctgttctgcctgttcttgattttaaatctgggatgggtgacgattgtccgcttcctagtgtggctgttaatcggcttggtaatctattttctgtattcaagaaagcattcaaaattaaatcaataaccttttgataaagagagcgtccatacaggccgctctcttttctgttcttggcaaatgaatctatagaaatgaagacaaaaataagagataatataggctggaaaggaagtgacgtttattgtctgagcaaaaaccagtccaatgggcttcgaaaattggtttcgtcatggcagcggccggctcggctatcggcttgggcgcgatttggaaattcccttacgtagcggggaccaatgggggaggagccttttttcttatcttcgtgttatttaccatcctcttaggctatccacttttggtgggggaatttatttttggaagacggaaccagacgaatgccattgatgcatataaaaaagaagcgccgcgatcagcttggtttcttacggggtggatcggcgtagccgcgtgtttcttagtgctgtcgttttacagtgtaattgggggatggattttgctgtatatagtaaaaacggcgtcaggctcactgtccgggctttctcaagcacagtatggcgctctttttgcttctattatccaaaatccggtgcagacgctcgcggctcagcttgtctttatggcactgactgtactcgttgtcgcaagaggggttcaaaaagggattgaacgggtaagcgcggtgatgatgccgattttgtttttattgtttattctgctcgttcttcggtctcttacgcttaatggtgcaatggaaggcgtaaagtttctgcttgtgcctcatttcggcgatctgactccggaatccatattattcgcgctgggacaggccttctttacgttaacactgggggtttcggtgatggtgacctacagctcctatttgccgaaaacacaaaatatccctcgttcggcagcctccattgtcttgatgaatatcattgtgacactcttggcaggtttggctatttttccggcggttttctcattcggttttcagccaaatgaaggaccgacactgctgtttacagtgcttccggccgtttttgaacagcttccgttcggcacgttgttttttatcggctttctcgttgcatttttatttgcagccttaacctcagcattttcgatggttgaaattatcgttgccacaatcggaaaaggggacgaaaagaagagaaaaaaactgtcatggacgagcgggcttttgatctttttggtcggaatcccatgctgcttgtcttatggcgttttgagtgatgtgcacctatttggcaaaacattttttgatattgccgactttaccgtcagcaatgttttgatgccttcaggcgctctgttaatttctctatttatcccgctgaaaatttcgaaaagcgaactcttggctgaaatgcgaaatggatcaaatgcaggtaaagcattcttttacacatggttttatttgcttcgttttatcgtgccgcttgccattattatcgtgttcttaaatttaatcggaattttatcattttaaaaaacaggctccgtttcaggggcctgttttttatttaataagatgatatcaacggtgcccatgccgttttcagattttggatgccgagcctgatatcctcttctgacaaaccgccataaccgattaagacagaagtaaaaggcgtctgttctatatatgagggagacacgggatagatggttacaccgtggtctgcggctgcttgtattgcttcttcctcacttgctggaaacaaaaggcgcagcaggatgtgaagccccgagttcttaccgagaatctcaacggtgtttcctagttcagagcggatggcttctaacaggacagcgtgtttttttcggtataagcttctcattctatttatgtgtttttgccactctccggtttcgatgaagtctgccagtgccaattgcgagtgaacagagacggtctgcttcattaactgagcgttgtttttgatcggttccatgagttcagagggcacaatcatgaagctgagccgcaaggaaggcagaagtgactttgaaaaagtgcccagatatatgactctgccattcggatcaaggccctgtaaagacggaatgggatggccgctgtagcgaaattctccatcgtaatcatcttctataatgaatgaatttgtttctgccgcccatgccagcagctcctgtctgcgggtaatcgtcataatggtcccaatcggaaactgatgcgaaggagtcgtatacatgagataaggattctgacggtagagctcatccggcaggacgccttctgcatcagaacaaatcggagtgacatccatgtgatttgcttcaaacatccttcttgaacggtgaaagcccggttcttcaaagccgatttttgtacctggctttagcgaaaggcaaagaatttgcagaagcacggtggttcctgcgccgatgataatctggccgggttcacaatttactccccgagcctgacgaatcgggcaatcatgtgcctgagttcgtattctccttgagggtcgccagaggtgtgaaacgatccggaatagcgatcaagactttttactatgctttttctccatgcgttaaagggaaagagggtcgggtcaacgttgccttgatggaagtcaatagcaggtgcgttcttttcatgtaatcccggctgtacagactgctgaaaatggtcaggagctgtcgggaagcctggttctacttccgccgcgaaccagccgatttttggcttgcttttgacatagccctcagcagttaattgctcgtaagctcgttctatagttgccgtgctgacatcgagcaagctggagagcctgcgttttgacggaagtcttgttccctttgtgattcgcgcatatgaaatttcttgtttaaaaaaggtataaagctgctcatacagcggtgttttgctctttttatcaagaaacggcgtgatatccatctcgtgtctcctttttatctggcatggttattttttctgatattggctatttggcaaatgccatttattagctatgatcattgtaacgaaaggaaaggggattgagaagatgatccatatgaaacaattaacctcgaaagaagaatgggctgagtcgtatccgattatgagtgaattgagaacagaactggatatagagacgtatttacaaaggcttgaagcctgtgtgcagaaagaatcgtatatgctgtttgccttatatgaaaatacagcaatcagagcgctgtgcggggctctgccgagagtttccattcataaaggagagcacttatggattgcggatcttgttacaacggcaccttgccgatcaaagggatacggcaaaatgcttttggattatgcctcagactgggcgagaaaagccggacttggttttgtcagtctttcatctggcctgcagcgtaaagacgcacatcgattttatacagataaaatgggttttactatagaaagttatttgttccgaaaaccggtataacgaaaaaagacgcctgaaaaggcgtcttttttaaaagccaaactgtaaattcgtatctacagatacaatggtatacacacaaataatcacaaagagattaaggatgacgccgagcaggcctggacctgtgcgccctctcttgatgaagagttcaacaacgccgaacggaacggcagccatggcgaacggaagcatttgataggaataaaacgtgacgttgctgataatggccaaattcagcaacagcagggacagaaccgctgtcccgacagagatccagccgaatacattgtgttctttaaaaattcttaccagttccataattccacctcgccgacattcgctgattttacagatttatttttcagcatgcgctggatttccttggttggccctgtaacgaccgaaccgtatacattgacaccgtttttctctacataatctaatcggttatctacattcagatctttccgttttgaaatgacctgagcccatttttcgtgtttggacatgaatttcagggcgttgataaactgatcgccattcgacttgccttttgtattaagggcggccaggaactttgaatcctttccaggatagccaagaggttctgtggaagctgtcttatttgtgtttttctctgtttcgattgcgttccacaaaaagctcacatcatagcctttgaatttgttatacacgtcttttgtcggatatgcacggtcatatgaaaggtagacctctgataccgttccttcaggcaatgtgcttaacgttttttctgcttttgcggtcgtttgttcagacttgtttgaaggatgtgtaaagtaatggccggttttattcacttctaagtcatagtagtttactgccggcgcttttactttgttataaaacatttcaacccgttcattccctacggcagccgtcttcgtgccaatctgcttttgcagcgggaattccgtattcattccaaatagcttcacttggcttttcagtccggaagtatcaacaagaacattcggcatggtcagggctacagtgactgcggcagtttccataaactcattgccggtgctgtgttttccacccattccgtaatagaggtagcttcccagcgtacaaagcggcaaaatcatcaatgtcgaaatgacggcaagcacagaaattcgcaaataagacttgcgtttgccgtaggctaaaatcgctttttgtttttcaggactgatgctgagatcccaatcgttatcgtcctcgagttcgctgtcaatcagttcctgatatacttcaagcttctcaagttcttcctcaaatgcagtcatttcctggtcgctcatttccccatttttatattgatcaaaacgctttttaaattcttcattcatcattaacacctctattataaagtgctttcagccgctgtctggcacgaaataaaacacttttaaaattcgcctctgaaatattcataatatgggatgcttctttgtagtttaactcttttaaataatatagcgttaaggcctcccgataattatcggggagctcggacatataaccagtcagcacttcctttatctctacctgatgggcaggactttgaacagcattttgaaagaggcttccgattaagtcatcagaaatggttacttctttcttatgctttctgacgtaatcaatgaaggcgtttcgcgccacttgaaaaagccagggctttactttgctgtgatcataggagtgaatgtgtatgtatgcccgcataaaggtttcctgcagcaagtcttcagcaagatgcttgtcttttgtcatggagagcaggaacctgtaaacatcattcatgtacatttggtaaatttcatcgatcgtcactgccttttctcccctctatgttatacacgcataagaaaggtttaaagttgcacattacatgcaaacggcttttttatacctaatcaaacaccattactatatagtacccaaaaatggccccaaaagatagtgcggagaaatgtttaacattttttccagaggggaaaagatagtgaaaaaagtgaaggagtggcacaatggaatataccagtatagcagatacaggaatagaagcctccagaatcggcctcggcacatgggccattggcggaacgatgtggggaggcactgacgaaaaaacatcgattgaaacaatcagcgccgctcttgatcaggggattacactgattgacaccgcaccggcttacggcttcgggcagtccgaggaaatcgtcggaaaggcaatcaaagagtacggcaaaagagaccaggtgattctcgcaacgaaaacggctctggactggaagaacaaccagctgttccgccatgcgaacagagcgagaattgtagaggaagttgagaattctttgaagcggcttcaaacagactatattgatctttatcaggtgcattggcccgatccgcttgtgccaattgaagaaacggctgaagtcatgaaggaattatatgatgcgggaaaaatccgggcgattggcgtcagcaatttttcaattgagcaaatggatacatttcgcgccgtcgcacctctccatacgattcagcctccatataatctgtttgaaagagagatggaagagagtgtacttccttacgcgaaagataacaagataacaacattattatacggcagtatatgcagagggctgttaacaggcaaaatgaccgaagaatatacatttgagggcgatgatctgcgtaatcacgatccaaaattccagaagccccgctttaaagagtatctttctgctgtcaatcaattggataagctggcgaagacacgttatggaaaatcagttattcacttggctgtcagatggatcttagatcagccgggagcggatatcgctctttggggagcaagaaagcctgggcaacttgaggccctatctgagattacaggctggacgctgaacagtgaagatcagaaagatatcaatactatattggaaaatacgatatcagaccctgtcggaccggagtttatggccccgccgaccagagaggaaatataacaaaagctgagggcgaatcctcagctttttggcgttttaacgggagaaatcttaaaaattagtaccaggtaataaaaaatgttgttataatagatgacagaaagaatcattgattacgacaaaggaagtgcgatatgtataagttttgtgcaaatgctttaaaagttattctttctcttcgcggaggagtgaaggtgtataacaaagaaaaccttccggccgattcaggttttgtcatcgcgtgtacacattccggctgggttgatgtgattacactcggagtcgggattcttccttatcaaatacactacatggcgaaaaaagagctttttcaaaataaatggatcggttcgtttctgaagaaaattcatgcttttccggtagatcgggaaaatcccgggccaagcagtattaaaacgccgattaagctgctgaaagaaggagagatcgtcggtatcttcccaagcggaacaagaacctctgaggatgtgcctttgaaaagaggtgcggtgacgattgcgcaaatggggaaagcgccgcttgtccccgctgcatatcagggcccttcaagcggaaaagaattattcaaaaaaggaaaaatgaagctgattatcggtgagcctcttcaccaggctgattttgcccacctgccttcaaaggaaagacttgcagcaatgacagaggctttgaatcagcggattaaagaactagagaataagcttgatcagctataaggcgttctgagagattgccctgaactgtgaaaataagaaaagcaccttatacaaggtgcttttcttattatgcttcctgctggttagctgtctccagaagttcttcttcttgaagctttttcacttcaatatatgcgacgtggtggccgtcaatttcattaatgatgaattcgcagccctcttcgatgatggaatcatctttttcaacatcgtatttttgagtaaggaaccagccgccgattgtgtcgacttcttcgttctctaaatgaatgcccagcaggtcgtttacttggtcaattaacacttttccgtcaagaatataatggccttcgccgattttgcggatttcgctaatttcatcaatatcaaattcgtcgcggatttcaccgacaatttcctcaatgatgtcctcaaccgtcacaagcccggcagtaccgccgtattcatcagacaaaatggccatgtggaccctctctttttgcattttgacaagcaggtcttggatcggcgcagattcaatgacatgaatgatcgggttgacgaattgagaaatggtggaatcaacagatacctcaccgctgatgcaggcggtcagcacttctttaatgttaataaccccgataatgttatctttatcgccctcttccacagggtagcgggtatatttttcaatctgaatgatgtccatcatttcagaaatcttgatatcatgcggaaggctgacaatttcggtccgcggaatcataatttctttcgcgagcctgtcgtcaaattcaaagattttattcacatatttaaactctgattggttgatttcaccgcttttatagctttcagacaaaatgattcgcagctcttcttctgagtgtgccagttcgttttctgaaacggtctccaggccaaatgctttggtcaataaccgtgcggaattgttcaaaagccaaatgaatgggaacgcgatgcggtaaaaccaaatcagcggtttcgcaaacagcatagacactgcttccgccttttggatagcgactgtcttaggtgcaagttctccgacaacaacgtgtaagaacgtgataatggcatacgcaaaaataaacgatatgacatgtgaaagggaacctggaacgttcatttggacgaaaagcgggtgaagcagcctttcaatcgttgattcacctaaaacccctaatccgatggaagtcaatgtaattccgagctgacacgcagataaatattcatcaagatgcgtggtcactttttttacggctattgctgctttatttccttccgcgatcagctgatcgatccgtgagcctctgattctgataatggcaaactcagatgccacgaaaaatgccgtcagggcgattaaaacagcaactaaaatcaaattcactatgtccaattagaaccttcactctagcaatgagaatgaaggtaacacctcctgttagataaaatggttttaacttaacagcagcataaatgattggaacacggcgagcttttcaggcgggagtttgcttttcagcttgtcacgatcctcgggcttcagccgttcaaaccgatgcaagattccggagatgttttgattcatatgatcaatttctaatgccagatttccaatttcatcatcaagtttagctgaagagggaaactggttctccagtcgatctttaatatcggacagggccaatcgctgcttcttgcaatctacaataaatataagtcgtttgagtgcattttcgtcgtagtaacggtaatttgaacaggatctggccggcgtaagcagaccgagattcgtataataatcaactgtccgtttcgttactccggcgagtgccgctagttcactgatgcgataagtctcagccccatctatatccctcccaaccatcacgttatagttatgagaatagtttaatatatgaacggtgtcttgcacaagtttattgtttttttcagaccggaattggaagttgtggaattcatcatctgattgaagtaacataggaagatagaattttcaaatttttatatgcggaagggacagatgaaattggctgggttatcccgggaagttgaagaaaatttaaataaaggatcatggattcgcaagctgtttgatgaaggtgcaaggctgaagaaggagttcggggaagaccaggtatttgatttttcactcggcaacccgattgttgaaccgcctgaagcttttaagagagcgttaatagaggaagctgaaaaaggcagccacggatacatacaaaaccaagggcttcctgcagcgagagaaaaagtcgcgcaatttctggggtcacgttttgaagctgatttctcagcggagcgtatcgtcatgacggtgggcgcgggaggcgctttgaatgttgcgttaaaaagcatcgtaaaccctggggaagaggtcattattctcgcaccttattttgccgaatataagttgtatattgagaactacgggggaaaggccgtcagctgcccgttgacaagccggtttgagatcgacattgaagcggtaaggcaatcgatcactccacagacgaaagggctgattctcaatacaccgcataaccccacaggcactgttctcagccagaaaaatatagacgatttaggcgctttattaaaagaaatagaagagaagagcggccagacgatttatgtgctgtttgatgaaccgtacagtcaattaatctatgatgaagagctggcaaatccgtttcaatcgtaccatcgtgtgatattggccagctcattcagtaaagatctcggcatagccggagagcggctcgggtatatcggattggacagccgaatgccggatgcggaccttttgatcaacgcttttgtgtattgtaatcgaacgcttggatttgtgaatgcccctgtcatgatgcagcgggctgtggcacgaatggatgatttaagagtagacgcgagcgcttataaagagcgccgggatttaatggtagacattttaaaagaagccggttttgaatttgaaatgccaaagggaggtttctttgtttttccgaaatcgccgattgaagatgaagttgcattttgcgtgcatgccgcccaaaaatacaaattattaattgtgccgagcagcggttttggaatgagcgggcatttccgattatccttcagtgtgccgatcgagcagattaaaaactcacgggacattttcatttctttatataaagattttgcttaagaaggcaaagaaaagaaaacagttttcaaggctgttttctttttatatccacaaaatccttcctcttccaatccagacaggcgcagaattgacaagcaggcatgcagttaaggctttcttcatgataaaagtctaaaaattaaaaatcatttttggaatgagttgtgttacaataaaatatacaatttataatcaaactttgacttttggaggtggtatgatggggccctctgcttaggcaacaatacaccgcgtacctcaatgttaaggaaaaatgattatatcaggaggtgactccttatcctttgttgagaggatagggttaaatggacgatattgacagtctgattttaattggcgtgctcattgctttaaccgcgtttttcgttgcaagcgagtttgcgattgttagagtgaggagatccagaatagatcagcttatcacagaaggaaacaaacgggcgatactcgcaaggcgtgtcattacagatttggatgaatatttatccgcatcccagctgggcattacattgacatcaatcgggcttggcgtactgggtgagccggcctttgaacggctgctgcatccactgtttgaaccgctcggcttgccagactcggtttcacatgcagcctcttttgcagtcgcgtacggcttgatcacgttcctgcacgttgttgtaggtgaactggccccgaaaacggtcgcgattcaaaaggcagaacagctgactttactgatagcgggccctttgcgtttattttatttgctcctgtttccgtttatttggatcctcaatggatcggcgcggcttttatgcgggatgttcggtttgaagcctgcgtcagaacatgatggttcccattctgaggaagaactcaggatgctgttatctgagagtttaaaaaacggagagattaatccgtctgaatataaatatgtgaataagatttttgaatttgataatcggatcgccaaagaaattatgataccgcggaaggaaatggctgctgtgtcaactgagatgacgatggccgagatgcttgaagtcatgctgaaggaaaaatacacgcgctggccagtcacagatggagacaaagacagtgtgatcggtttggtcaatacgaagcatttgttttctgatttgctgtttatgacagaagaagaacgaatgaagatgacgatccatccgtatgtgaggccggtcatcgaagtgattgaaacgatcccggttcatgacttgctgattaaaatgcagcgcgagcgcattcatatggctatattgtcggatgaatacggaggaacctcgggacttgtgacgacagaggatattcttgaggaaattgtcggagagatcagagatgaatttgatgaagatgaacagccgctgatccaaaagcttggcgacggccattatgtgatggatggaaaggttcggatcgatcaggtgaacagccttcttggcgcatcgattcaagaagacgtcgatacgatcggcgggctgatattaaaagaaaacatcgatattgaggctggtgaatccattcgcatcggttcatatacgataaaggtgctgaagatggacggccgattaatcaagcaaatcgatataaaagaagaagccagcaacacaaccgggattacggcgcaccacaagctgccgctgcctgagcctgtgatgctgaacagtgcaaccttgagcgagaaataagctcaaggtttttttatattgtgattgtccagccgcaccaaaatgccaaaagcgacccgcaaagtgtcagggcgatgtacaagatgctttctattacacgtttggccataaggagttgaatactttcaacgctgaaggtggaaaaggtcgtaaaggcgccaaaaaaccccgtgccgatgataagcgagaccgaagcatttgcaacgtgaagtcctgtaaatattccgagcccgagagctccgagaatattgactgtcagtatgccaatgggcaggctcagacctttggttttggcggttatgacattgccaagccagaaccgaagcattgcgccaagtccgccccctatgaaaatacccgctagtgtcatctttcctgcagcccctttctttgctgaatgcctgctatgcgccgtcccgcaaaaacaccaatcagtgcaaatatgatccctgatatcaatgaggctgccacatataaaagagccaatgagggttgtccttgcaaaagcatcaccgtttccttagaaaacgtggacattgttgtgaagcctccgcaaaagccggtgcctaaaaaagccgacagcagaggccgttttgccccgatcataaaaaatccggtcaaaatgcctaatagaaggctgcctgccgcattttccagccaggttgccgccgggaactgaccggtgtgtatccataagtttaatccgtatcggaggcaggcgccaagcgcgcctccgataaaaaccgcgctatatattttcatgtttgccatcctttatgatgaaatccgggtaatctgtaacgatgccgtccacgcccatggcttgtaattttgctgctgtcttttgattgttgacagtccatgcaaatatgtttaagccatttttatggacggagccgatcatcagacggttgagccgtgtgtattttatattgacatagtttgcaaaagagcggaaggccttcatctgatttctggacagcatgccaaagttgggccttgtaataatggctgtcggaatcgaaggataaagctcgcggaacctttggacggagcggaactgaaaggattgaacaatattattgatagaaaaagaaaattgccctaatagctgtcccacctcttcttcaattccgacttgagacgcatggccttttagttcaattaaaaggccgatttttttgtggtagcgcttgagcaccgcttccagggtcggaatacgctctccttgaaaagcgggaccgtaccagcttcctgcatcgagtttttgcaattcctccaaggtaaaatccttaacaaagcccgatccgtttgttgttcggtcaaccctgtcatcgtgtatcacaacaatctgcctgtcttttgtaagctggacatccagttcgatcatatctgcattcattttcaccgcaaggtcaaatgaggcaatcgtattttccggagcgtagccggatgctccgcgatgggcaatgatgtacaagctaagtcagctcctcgtatgggcatttctgttattgtatcaaatccatatatgcaccgcgatacaaactggtgaattttttctgtcatatcggaatggtccgggctgaggaatgcgtataactaaaaaaagacactcagcgtatcagaacacatttcgtcagaaaattaggtctttcgacatgttcacaacaaaatatgatcctttataatagcaaaaaaggaggcgagatcatgggaaaagggagaatcagagtggaggaaagaattaaagccgaaacggatgctgaaatgcaaaaagcaactctccttgatcagacacaaacgaaaaaaggtaagtgactgtccctattgaatctggctgatagatgaattgagaaatgaccccggcgtttcgccggggttttgtgctgcaaaagacatttaaatgaacatctttacgaatattttagtataataaacaattgattgggatagaggggagacagtcatgccggattatttgcagcagtattttacgcttgataacatcatacaaatcggcatcagcttggcgattttgctggtgtttcttatactgagaaaattattcacaagatatttctttaacttgctttttaatttgacaaaccggccgaaaacagaaatttttaaacaggtggttctggcgtttgataagccggccagatggttttttgttgctcttgggctgtttttagcgatccggtattcaccgtttttagatgagcaaatgccggtcatcagcaaaatataccgctcactgattgtggcgctcttgtgctggggcctttgtaatttgaccgcaacatcgtcgtttatcttccataaggtgaatcagcgcttcgagcttgacatggatgacattctggccccgtttttatccaaattgctccgttttgtgatcattgcgctcagtgtcagtgtgatcgctcaggaattcaattatgatgtcaacggatttgtagcgggcctaggtcttggcgggctggcttttgcgcttgccgcgaaggataccatcagcaacttcttcgggggtattattattattactgaaaagccgtttacaattggtgactgggtggagacgtcgacagtaacaggatcagtcgaggatattacctttaggagcacgagattcagaacagcacagggggcgcttgtaacggtgccgaactctacgctgtcgatggaagcgatcacgaactggacaagaatgaccaaacgccagattacgttttccatccatgtgtcctacgctacgccgattgagaaccttgaacgctccattcattctctcagaacaatgctcttagagcatgagggcgttgataatgaaacaatcatggtcaacttcgatacgtttgccgacagctactacaatttattttttaacttctatacaaaaacgacggtttgggctgaaaaccttaatattagagaggatatcaactataaaattattgagattttaggtgcagaaggtgtccagtttgcatatcccggccaaatggttgttgtcaagcaaaagcacgaaagcgacccattccaggtgaatctaaataaagaggaaaaggaacgggcttaaaagagagacttcgtctgacagaggcggagtctttttcatggtaaaataagagaaaaaggcggtgttgagttggaagcattcaaaagtattctacatgaagcacagcgaattgttgtgctgaccggagcgggaatgagcacagaatcagggattcccgactttcgttcagcagggggcatttggacggaagatgcctcaagaatggaagcgatgagccttgattattttttaagtcatccgcgtctgttttggcccaaattcaaagaattgttccagatgaaaatgagcggcagctttgaaccgaatgaaggacacttgcttttagctgagctggagaagcaagggaagcaggtcgatattttcacgcaaaacattgacggtcttcataaaaaagcggggagcaggcatgtatacgaactgcatggttctatccagacagcagcttgtccggcatgcggcgcccgatatgatcttccccatttgctggagcgggaggtgccggagtgcacggcggccggaaacaatggggacatttgcggaacggtattaaaaaccgatgttgttctctttggcgacgccgtcatgcactttgacaccctttatgaaaagctggatcaagcagatcttttattggttatcggcacgtctctcgaagtggctccggctagatttgtgcctgaggatgcaagcctgattcccggcatgaagaaagtcatcataaaccttgaaccaacgtattgcgacagcttgtttgacatggtcatccatcaaaaaatcggcgagtttgcccgaagtttgggcatgaaaaagtgagccgctttatgcgcctcacttttttattcatgaacaggaaccattgtgtcctctaacactccgaaggaatagcctttttcttttaatttattgattagtaccggcagcgcatttacagtagcaggaagatcatgcatgagaattacatttgggcggcttgaagagctgtgttccatattctcaagctgctgtaatacggcggtcacatactgtgaattccggtatttccagtccatgctgtcgatcgtccaatcccagtacacaaacccatctttctccagattgcgaatttgtgaggcggttagtgacggcttgcttccgtatggcgttctgacaagatcggttttatatcctgtaatgtcctgcagcgtgtcacgcgcctcctgcatttcttttagcggagatgtcggtgtttgatagaacaatctgttattgtgggtaacgccatgtaaaccgagtgcgtggccttccttttctgctcttttcacagcctgcttgaattcgttcatccgcggtgacagcataaaaaacgtcgcttttacatcagcgcttttcagtacgtcgagcaagcgggttgtaacggctgaagggccgtcatcgaaggttaagtaaaccgttttatctcccatgtcctgctttgtctgcagatgttttatcagcagatcgggggagtcgtttttcagcttaaggctttccttctcatctcgaagctgtccgttagttgtgacagtgacttcctttgctttcgttgaactgttggaataacccaaaatcaccataagcaaaagcagcacacataaaactgctaaacttgcaaatttaaaagcaagcgaaactgcagaaggagaagcctctcctctcgtttgtcgcataacaatctctccattggcataaaatctctacataatgctgtacagcaggcagcttatgaaggtgccttgtgtttacaacctatgtattaccagtcaagtatacaggaataaaactggaaagcacatagaaaagttgtcgaaatgtcagattttaaggaaaaaataaactcttttccgctatagatctcttgatctttctgtttttcagcatgtccaatatgatagaattagtgacaatgacagcttgaatgacatcagggacatctcgaaaagggagggcttttatgaaggtattagtcaatggccggctgattgggcgcagtgaagcatcaatcgatttggaagatcgcggttatcagtttggtgatggcatctatgaagtgatcagggtgtacaaaggagtattgttcggcttacgtgagcatgcagagcgttttttcagaagtgctgctgaaatcggaatttcactgccattcagtatagaagatctcgagtgggacctgcaaaagcttgtacaggaaaatgcggtcagtgagggagcggtatacattcagacaacaagaggtgtggccccgcgaaaacaccagtatgaagccggcctcgagccgcagactactgcttatacgtttacggtgaaaaaaccggagcaagagcaggcatacggagtggcggccattacagatgaggatcttcgctggctaagatgtgatatcaaaagtctgaatttactgtataatgtcatgacgaagcaaagggcctatgaagcgggagcatttgaagccattttacttagggacggcgttgttacggagggtacatcctctaacgtttatgccattatcaacggcacggtgcgaacacatccggctaaccggctcattctcaatggaattacacggatgaatattttaggactgattgaaaagaatgggatcaaactggatgagactcctgtcagtgaagaagagttgaaacaggcggaagagatctttatttcgtcaacgacggcagaaattattccggttgtgacgctcgatggacaatcggtcggaagcgggaaacccggaccggtgaccaaacagcttcaggctgcttttcaagaaagcattcaacaggctgctagcattcataaatgaacgaagaaaagagcccgctttttacagcggagctctttttattttttaacaaaaccaatcaaaatggagatcatcggcgatatatagaggaagaacgtaaacgggatgtagtctatgactggaacaccaagtgcgctcgccataaatgcgccgctgacgccccaaggaatcaatgggttaattaatgttccgccgtcctctaatgaccttgtcagaaatttccgctggatgttttgtttgtcgtataaggatttaaatgattgtcctggtattaatatcgataaatactgttcgccggttgccaagttgacgccgatgcttgagcagacagttgctgcaacaagacggccttttgagcggatgcctttcatgacgccttccaatagtgcagaaatcaatccgattttctccatcaatccgccgagtgcaaaagcaatcataatgagagagacagagcccatcatggattgcagtccgcctctgttaataattttagcggctgcctcattgtcagtttcgaaagttgtgccattttgtaaagctgtcataaacgcctgcaggctgctgtcgggtacaaaaatagcagtcaaaattcccgaggaaataattccggcagtcagaacggggattactgatacccgttttattgccagcaaaacgactaagagcggagaaagaagggcccacggtgtcacgtttgcagcatcttttattccggttatgacctgctgaatattatcggttgaagcagcgtccgctgacactgatgaaccgagaaagtaaaacagaacgacagtgatgagcaaagctggaatggttgtgcccatcatatggcgaatgtgttcaaagatcggtatttcgcctatcccggctgcaaagttggttgtgtccgacatcggcgacattttatccccaaaacaagcgccgcatatgactgcgcctgctgtccattcaagcggaacgccagccgcgctcgccacgccgatcagcgctactccgattgtgcttacagttgtcaggcttgagccaacaagtgtgctgatgatcatacatgaaaacaaagcagtcaacagaaggtggcttggttcaataaaggatagggcataaactgtcacagtcggtattgcgccgctgtacatccaggcgccgattaagatgccgatcagcgctagaacaataatcggctgtacgccgtttttgatcccgtctacaatccctttttcaatactcttccaggaaaatccaaaccataaagctgctgctgaaagcatgacaacacttaaaaacagcgggatatgaggttctacatgaagcaagaataagcaagaaataataatgcataacatcaatataaataaaccgacggctaacggaaacgtcagctttttttgagaatccaaaataacaccccatatttatctttaatgcttttgtgcttttgggcacgaaagcattataacagaaaaaaacgaaaatctatgttttttcacaattatgaatataaaagaagtgagcacagggcgtgctcactttacaatcaggacgggtatatccgatttcgctgaaagcttttcacttacacttccgaatattagctttttcagcctgttttggtctctgcttccggttacgatcatatcggcagaaatgcggtttgcatgctcgataattgattcagccggatcgccttctaatatatcgatatctccatctgcctgctgttcattcagcatcattcttgcttcggcgatgacttcttccgtacggtcttcatagatcattggctcaggtgatgttacatccgatatcagcggatcaggaacacttgtcatgcctccgctgatatagcttgcctcagctgcgggtctgggcgggtcgatgacggtctgattgtctttcatatcatgtgaatgggcgacggtaatagcggcatttacggttttagcaagatcaatggctgtctgaagcgctttcttactattttcacttccgtcaaacgcaacaatgatacggtcagcatggaacatccttctcaccctttcaaagcgtcttacaacactactacccgaatttgagcaccattaaccttttcctattcaagtaatgattgacaataaaaggttttgtttatatgatgataaaaagatgaaatcagaatggaaggagggtttgctatgccaaggaatttgcgtgtttatcaaacagtttcatattggcgcggcaaaccttttgttctgttttcgtgaacggttttttaggtcggaccgcgcgctgaaaagcgctgtgcgtaacatatcggttaaaaaaggcatggagctgacgcttcatgccttttttatatacaaaatctaaggaaagacaggtgtatgggatgtgaagaccaatacagaggcgagggctgttcgtgccaaattggatgaaaaaagctgcaaggaaaaaatagaaggcggctgatgaggagatggggatagatgttttcagttttgaaaaagcttggctggttttttaaggcgtactggctgcgctatacgattgcgattgtccttttattagcagtcaatgtcattgaaatgtttccgcctaagctcttggggaacgccatagatgatatgaaagcaggggcatttactgcggaagggctgctgttttatatcggtatcttttttgtgctgacggcggccgtgtatatcatgtcttatttttggatgcatcagctgtttggcggagcgaatccgatggagaaaattcttcgtacgaagctgatggggcatttgctgactatgtcgccgccgttttatgaaaaaaaccgaacaggcgatttaatggcacgagggacaaatgatcttcaggccgtcagtttaaccacagggtttggcatcttgacgttagttgattctacgatgtttatgatgacgatctttttgacaatggggtttttgatcagctggaagctgacctttgccgccattatcccgcttccagtcatggcgattgcaatcagtctatatggaagtaaaattcatgagcggtttactgaggcccaaaacgcgttcggggcgctgaatgacagagtgctggaatctgtttcaggcgtgcgggtgattcgcgcgtatgttcaggaaacaaacgatgttcgccggtttaatgaaatgaccgctgatgtttatcagaaaaatatgaaagtggcttttattgattcactgtttgagccgacggtgaaactgcttgtcggcgcaagctatctgattgggctcggctacggagcgtttcttgtattccggaacgagctgacgcttggagagttagtgtcctttaacgtttatctcggcatgatgatttggccgatgtttgcaatcggtgaactcattaacgtgatgcagcgcggcaatgcgtcattagaccgggtaaatgaaactctttcttatgaaacggatgtgacagatccaaaacagcccgctgatcttaaagagcctggagatatcgttttcagtcatgtcagctttacatatccaagctcaacaagtgacaatcttcaggatatttcatttacggtgcgaaaagggcagactgtcgggattgcaggtaaaaccgggagcggaaaaacgacaattattaagcagcttttgcgccagtatcctctaggtgaagggagcattacattttcaggtgtaccgattcagcaaatccctcttgaccgtctccgcggatggatcggatatgtgcctcaggatcatttactgttttcacggactgtaaaagaaaatattttatacggaaaacaggatgcaactgataaagaggttcagcaagccattgccgaagcacattttgaaaaagatttgcacatgcttccgtccggtctggagacaatggtcggtgaaaaaggcgtggcactgtcaggcggacagaaacaaagaatttcgattgcgagagcactcatggcgaatccggaaatcttgattctggatgattcactttccgctgtagatgccaaaacagaggctgcaattatcaagaacatcagagaaaaccgcaaaggaaaaacgacatttattttgacgcaccgattatccgcggttgagcacgctgacctgatccttgtgatggacggcggcgtcattgttgagagaggcacgcatcaagaactgctggccaataatgggtggtaccgggaacaatatgaaagacagcagctgttcactgcggaagaagggggagcaggggcatgaaaataggaaaaacgttatggagatacgcacttctttatcgaaaattgctgatcacagccgtccttttgctaactgttgccgtcggtgcagaactgactgggccctttattggcaaaaaaatgatagacgaccatatcctcggcattgagaaaacatggtatgaagctgcggaaaaagataaaaatgccgttcagtttcacggcgtctcatatgtcagagaggaccgattgcaggagcctgtttcaaaagcaaaagaagcgcatatttatcaagtgggaatggcgttctattttgttgatcaggctgtcagcttcgacgggaatagaacggtttctgacgggaagctgacgatcacaaaaggagacaagagccgggcatatgctgccgaaaagctgactaagcaggaacttttccagttctatcagccggaaataaagggaatggtgttactgatctgcctgtatgggggcttgcttgtgttttcggtattctttcaatacggacagcattatctgctgcagatgagcgccaatcggattattcaaaagatgaggcaggacgtgttttcgcacatacagagtatgccgattcgctattttgacaaccttccggccggaaaagtcgttgcgcggattaccaatgatacggaggctatcagggatttatatgtcacagtgctttcaacatttgtgacaagcggaatctatatgttcgggatattcacggctttgtttctgcttgatgtgaagcttgcgtttgtatgtctggcaattgtgccgattatctggctgtggtctgtcatataccggagatatgcgtcatattacaaccaaaaaatccgctcgatcaacagtgacattaacgcaaaaatgaatgagtcaattcaaggcatgaccattattcaggctttccgccatcaaaaggaaacaatgagagaatttgaggaattaaatgaatcacatttttatttccaaaacaggatgctgaatttaaactccttaatgtcccataatttggtcaatgtcatccgcaatcttgcgttcgtctgtctgatctggcattttggcggtgcgagcctgaatgcggccgggattgtttctatcggtgtgctgtacgcgtttgtcgattatttgaaccggttatttcagccgatcacaggcatcgtcaatcagttttcaaagctggagcttgcaagggtctccgccgggcgtgtttttgaactgcttgaagaaaagaatacggaagaaccgggtgaaccggcgaaggagcgcgcgctggggcgggttgaatttcgtgatgtgtcatttgcgtatcaagaaggtgaagaggtattaaagcgtatttcctttactgcgcaaaaaggcgaaaccgtagcgctcgtcggccataccggatcaggaaaaagctcgattttgaatctgctgtttcgtttttatgatgcgcaaaaaggtgatgtcttaattgatggaaaaagcatttacaacatgtcaagacaggaactcagatcccatatgggcattgtgcttcaggacccgtacttattctcgggtacaatcggatctaacgtaagtctggatgacgaaagaatgactgaagaagaaataaaaaatgcactgcggcaagtcggtgctgagcctcttcttaagaagcttccgaagggcattaatgagcccgtgattgaaaaaggcagcacgctatcctctggagagcggcagttaatttctttcgctagagctttggcgtttgatcccgcgatcttgattttagatgaggcaacggcgcatattgatacagagacagaggccgtgatccagaaggcgcttgatgtcgtcaaacaaggacgcaccaccttcgtcatcgctcaccggctttcaacaatcagaaatgctgatcagattttggttcttgataaaggagaaattgttgagagagggaaccacgaggaattgatggcattagaaggccaatattatcaaatgtatgaactgcaaaagggacagaaacattccattgcataacgctcaaaaaacccaaaacaatcgggttttgggtttttggtttatgtagtcaataagccagtccgacacggtatccgacatactcacctgtaacgagctcacgatataaaaagtccgcagtatcgccgaccgaaatgcttgtgccgccctcaggcaaaacgttacgctccgtacgataaacgccggttgctgttccgtccgggaggtaagtggggcagatgattgtccagtctaatgatgattctttaagcatttcgtatacttttgcatgctccttggctgcgcgggtctgctttcgtttcgattcatttgtttcaaaccggtatttccccggttcatatcgggaatctaggatccctgcggtgccgatcgtaataagccgtttgatatgctgttcctccatagcggagagaatgtgtgccatagcagttgacaaggtatcatcaccatctgtgcctagacagctgatcacgatttcagcattctccattatttttttcacatcttctaagcggcgggcgttccccatgatggttctgtcttttgaaaggggaaaatcagcatgttgagatctgatcagagcgaaaatatcaaatctttcatctgctgcagcttgtgttaaaaaggcttgtccgacgcggccgctggctcctaataaagcgattttcatcaaaaaacctcctcgcctttcattataaaaggatgttctcagtttgaacagcgcgggaaagaatacctgtacaaataaacagaacgatgggaaacatattcatgaatcatggatacacttacgaactgaaccagctcccaattcacaatggtgatgaatgacaccccgattccctccctttttttctaggaaatgtggagtaggaaaaaagggtgacaaaataaagagagcgcggaaaccgcgccctctatagccatatattgaattgttattgaactctgccgcccatttgctgctgagcgaaagatactaaacgttttgtgatttctcctccgacagaaccgttagcgcgagaagttgtgtccgctccaaggttaacgccgaattcagaagcgatttcaagtttcatttgatcgatagcctgagctgcgccaggaactagcaagtcatttgaagagttttggttagccatgtgtaaaatctcctttttatttagtatggttgggttaactggagttgcaccagatctgtgaacccttatcgggtgtcactgccgcctcggcgtaacccaatgctttgccggcttgttactacgtattatgttaaaatggccggaaactcatgcggagaattgtgtggtaaatcttgagaaagcaaaaaaagcttagccgtttaggctaagctagtcataaatatgaaaaagcatcagttcatgtatctcgtttgtaagagcaggctcgtcagcgcgggcgggaaacaagtctccccattcaatctcaccgctcttatgatagatgccttcataatgggtccctttataataaaatgaaattttccatccgggcagcttttcttttgggaacaaaggtttccagctgaaatgagaaatcattacggccacgctccttacatttggtatcaattgacctgaataaaaacggcttatgttcattgtatcattgtttcagaacatcattgaagaggccttaatatgcagattgtcccagctttggataaagataagcccgctttattaaaaaagcggacaggttacgaaggccacaatgcttcaggagatgtgattgccttctcagataaatatgacgcgtattcaaagcttcttcgttttgtaagagaatcaacatgatgcaaatttggatgagaaaaaatgcttcggcctgggcgcgaattcgcttcaaacatccatactttaccgttctgatcaatgccaaaatcgaaaccaatctccccgataaacccctcgatatgatcatgaaggacatggcttgccgtcagtgccgctgcagaaagcttttttatgacctcaactctttcagtgggatcatcgtatacttccgcaagtgtctttacagtgccgccgttagaaagatgtgttgtaatgctgttctttccggaaatttttacggcgattgctgtcactgtccattttccttttctgtttttattggtatggacacggaaatccgctggtttgccttgaaattcgatgagatcaacaccttgctgaatgagaaagtcggacgtgttgtgctgtttttgaaattctgcaaggaatgaggcggcatcggaataatcaatcgaagtaaatgttttggcgtcattcgtatgctttaccgtcaggccgccatctgttcttttcagctgataaatgccggtgccgagtgctccatttgccggtttgatatagacttttttgtatgcgccacagagctcatctatcagctccacagacggtgtcagctcggatctaggcaaaaagggtgccgttctcggatctttttcgagcaattgatgaacgttccatttattgaaaaacgttttattaaaccatgggatctgatattcatcgatcagcctcttttttgtatgttgcaagagaagtgaatcttcaatttttcggttcggcaaacggtcataaacgacgttcggcaatggaacaatttttttctcccagccgttttccctgtaaaggaggccttcaatcgtgccttcctcccaattgatttggtgcgcgccaaaaacgaagcagtagcctccggcttgctcgtgtaacgtgacaagtttagaaaaaaagagggaacgatccttaaatggacgttcaagagatacagtaaaccctgccgtaaagatgccgactaacggcccgatatgcactgtatgatcatgaatcagtatatcagccctgcttcggtgggggagcaaaagctcatgaaacagattttcagagagtagcacggtttgttccagatgccgtctgtaagcaacgtggcatctgacaaccttcgttccgaatgcggcatgcaaaagtccgtctcgcttcagcgaagagggcagaaacagggtgttttcactggttttgtctatgccgatcaaaaaccgtttaggattcacgcggaagaactcctttctggctttgctcagaaaacagatattggcagcgctttaggggacaagtgtacagctgttctttttgctcgggagagacacgcaggattgacttcctgcccggttttgaattgatatctaaaatccaaattctcccgtccttagcaagacatatatcaagaccgagttcaaacaacggtccatagcgctcgtcaagataatacggaaccgattgggtaatcgaaaacacatcatctagtaaaaccacttgctgttttttcggtatatcttcaaaccaggagtcaaatgtcagcgcatcagatccgcctgacaaattggccagcagcccgtgtttgtatccgcgtcttactgcctttccgactgtattccattcacctgcttcgtttttttccataaacagacgaatatcacaagggtattgttccttatcttgaatgtttaagtaaggctgaagcaaatattgatgctgaagcacttttttgcaccatgttttaaaagaagtctggttggaaaacgtttttgtctgcttatcctttccgatgtgataagtagctgtgatgtttttcttgcccagcttcaatagaatcacgcctctgcctcccgcgccgaatgccggtttaaggatgcaggctttttctttggataaaaaggagtgaatttgttcgtagcggctcacctttatcgtttccggaatatagggattgattacagagtgctgctgcaaatcgtgaaggacggtccacttatcgggaagaccccgcccgataaattccgttttcggatattttttgagccactcaacgattggttttgctttttgggaatgtgaatccttgccgtaaaaacagcgatcataaatataatctggaatcgccatttcagtttcgttccatgtgctgctggccgaatgatagaccgatgctttgacacgcaaagtgtcaggtaaaatatcaaatggtgtaaaccggatgaaacgtatgccgaattcgggtgctcttttggccagttctgcggaataatccgcttcatgctggcgggataaggacataaaaccgagtgttatcatggtgagactcccccttttattcaaaagctgccggcgggtgtccgcagctttacactaaatacatgtaagacgaacgcagctgacggtattctactttacagaatacgattcttcaccttgccctattccaaaagaacaagctgattttctaagaacaggaatttgtctcctcgtttgctaagtgattgcatgagcctctataatacgtataggtacataatctatatgaaaaaagctgaagcacagatggaggaagatgaataggaatgggtattgcaggaacctttatttttatgatcgtgatcggcgctgccattggagcggtgaccaatcatttagcaattcaaatgctgtttaggccgtataaagcgtactatttgtttgggaagcgagttccttttacgcccgggctgattccaagacggcgagatgaacttgcaaaacaaatgggactgatggtagtcaatcatctcttaacccctgaaggcattaaaaagcggctcgtctctgatgcagccaaaacgcaggctcttcgagtgggggaacagctgattcaaaagctgtcactttctgaagtgacagtaaaagaagcgcttgaaaaagccgggatgaagcgccccgaaaaagctgctgatgcatggatcagcagctggaccgatgataagctgaatgagcttttccgccaatacggggaccaatcgttaaaagagctggtgcctatagaggtgcaggaaaagcttgaggaaaaaattccgatgatttcaggatatatattgtcacggagtgtccgttattttgaaagtgatgaaggaaaaatccgtcttggcaatatgattgatgactttttaaaagagcgcggcatgcttggaagcatggtgcaaatgtttcttggcaattcaagccttgcggatcgcgtgctgccggagctgctgaaattcttgcggaatgaggaaacaaataaattgctttctgatctcttaaaaaacgaatggggcaagctgagggagtatacgtttaatgaagcagacgaaaaatggaatgcaaaggcgctcattttcagtttgaaacgaagaatgctgcaagtattttcgactgcccctttcttcaacaatacgattggcacgcttaccgtccgctatgaatctgagctgacccagcaaatgctgccggcactgttagacaaattgcttgaagggatttcgtccaaccttgaaagtgtcttaaaacggttgcgtcttgaggaaatcgtcaaggagcaggtggatcagttcccggtggagcgtcttgaagaaatggtgctgtccatttcaaaaaaagaatttaaaatgattacctatttggggggccttctcggcggaattataggcgcgattcaagcactgtttgtcatccttttttaagaagaaatgggttttgattaatgaaaggatctccatagtctgttatagtggagtggtatgtcaaacggcaatgatgaaaggagctatttacaatggctgttaatttttatgatgtagcgtatgatctggaaaatgcattacgcgggagcgaagagttcacccgtttaaaaaacctttacgacgaagttaacgcagatgaatcagcgaagcgcatgttcgaaaacttccgtgatgtacagcttagactccagcaaaaacaaatggcaggagaagagattacacaagaagaagtgacgcaggctcaaaaaacagttgcgcttgtacagcagcacgaaaaaatttctcagctgatggaagcggagcagcgcatgagcatgctgattggtgaattgaacaaaatcattatgaagcctttagaagagctttacggcagtgttgaaggctaatcagcaaaatcccttcttggataagaagggattttttattcattcagcaaacttggaaatccaatgaatcttttacctctccattgatgatgactgataatgtatgaattcctttgtaatgctttctggtggttaaatccttaaaggattggattcttgtgtatgacttcgtttcgttttttcgtatatttgtttctgttattttaaatactttctgatgacgctggcctcttgcttttacaaaatcaattgcgtactcaattcttactttttgatccctgtctgaatgaatatagaaagaaaattcaaggctttcgccaataactatacgtttgggctggcatgttaaatcatgtagttgtatcgaatcagcattttcataaccaaaaagcgctaaggcctgtttatcacccttttttaataaggtccgataggcgtgtttgataatccagtctgtatggggatgtgttccgtaccattgatctgcgacttttctcagtaaatgaggatgcgtttttgatatatcattaaggttgttggccacgcttttccttacatataaggactcgtcctgcatcagcttctcaaggatcggcaatacgggggaagggtccgatttcaaagccggtatcgattttccccatggcaggcggggcctgctgccttcgctcgcaagtcttctcacgtgttcatttttatgctcagaccatgcaagcaattgtgcaatcatcttttcttgatctaacagcaaaaaaggccttacagcaaattctgaggtcgaatattgcgtaaagtattccaatgcctttattgattcttcccaatgcgctaacccgtactgttccacataatctggaaataaaattccgctgagtcctttaaaatgaggggctgtatcccgtaaaattgtgagcgcttcaacgtattgttttggcaaagtttcgtataaagaaactgtcacgcggcgcatccgctcttttaaagtgagttcaggccagtcctccagccgtaatgtacccaagaatctgtttttgttaaaatcaggataggatgaccttacatgatggatcaactgagatatcagttcttcattatatatttcttttaaatcagccatataaacaccgctttttcgtttattatttatattgtatgggaatgtacgttctggatcaagtgtatagtcctaaaaattaacaactgatcctaccacggatatacaaaagttggttactttttttagttaaaaaaacccttgtcatcggaaaggaaaactgagataataacattgaaagcgcctacacttacctatttcaaatggatacggtcgcatatcatgccgttatatagaggggataagcaacagagagtaagtgttcggagcgcatcattggtcaaacaaggggttcctgatacatgatttttcgtaaatcgaaataacgatattagggagaatggctgcttcgatcgtatcctatcaacaagccatacataaagtctgctgagccaggctttttttgctttaagaaaaggttgttctaaacacagagacagggtcatatcctatacacaagtacagtcatcaaggagggggacatctctgtgtcaaaacaattgcttgccttaaatatagatggagcgctgcttcggtcgaacgggaagattcatcaggcaacgaaagacgcgattgaatatgtaaagaaaaaagggatttacgtcacacttgtgaccaaccgtcattttcgctcagcacagaaaatagcgaaatcgctaaagcttgatgccaagctgatcacccatagcggggcatatatcgctgagaaaattgacgccccgttttttgaaaaaagaatttctgatgatcatacctttaacattgttcaagtgctggagagctatcaatgtaatattcggcttcttcacgaaaagtattccatcggaaacaagaaaaaggtgaattcgaatttattggggaaagcactcattcatccgtctgacccgatcttttatccagtccagttcgttgaatcattaagcgatctcctcatggatgagccggtgagtgcacccgtcatcgaggtgtacacggagcacgacattcagcatgacattacagaaacgattacaaaagccttccctgcggtggacgtgattcgcgtaaacgatgagaagctgaatatcgtcccgaaaggtgtctcgaaggaagcgggtttggctctcgtcgcttcagagctgggccttagtatggatgatgtcgtggccattgggcatcagtatgacgatctgccgatgatcgaacttgccggtcttggggtagcgatggggaatgccgttccggaaattaagagaaaggcagattgggttacaaggtccaatgacgagcaaggtgtcgcttatatgatgaaggaatatttccgaatgcagcagcgaaaaggatttcttgataagttccacatgaaacgtgtgtaaaaaagccgctcgcaccctgacaggtgcggcggcttttttgccggattgattttagcagtttatttctgtacactaaagaaagttttgaatctgataaattaggtgatgaagttgcaaattaaaatagaaggcatacatgatgaccgcctgcatcggcctctgcaaaatattgcaaatttgttttatgaagagtgcgagcttgcgtatggcggagaggagcccgcagatttggtcatttctttagcgttgtcacaaacggatgagcatgtgacggtttcgggagaagtgaagggaactggcataaaggaacagcatacaaaattcttttctcccggcatgaatgaaaaagaagcttttaagcaagtgaaaaacacaatttcttatgtgtatctcaatcttcttcaggcgcatacgggcattacgcagaagtggggaatcctcacaggaatccggcccacaaagctgcttcataaaaaactgcaaagcggaatgtccaaggagcaagcgcatgctgagttgaaaaaagactatttaattcatgatgaaaaaatcatgctaatgcaggaaattgttgatcgtcagcttgcggcagtgccggatttgtaccgagtaaaggatgaagtcagcatttatatcggcattccgttctgcccgacaaaatgcgcgtattgcacattccctgcgtatgccatccagggacaggcaggcagagtcggctcattcctatggggactgcattacgaaatgcagaagatcggtgaatggctgaaggagcatgatgttaaggttacaaccatttactttggcggcgggacgccgacaagcattacagcggaggagatggatctgctgtatgaagaaatggtccgctccttcccggatgtgaaaaacattcgtgagattacggtggaggccggtcgtcctgatacgattacagaagaaaaactcgccgttttaaacaaatatgacattgatcggatcagcatcaatccgcaatcctatgaaaacgaaacgctaaaggcgatcgggcggcaccatacggttgaagaaaccattgagaaatatcatctgtcacgccagcatggcatgaataatatcaacatggacttgattattggtttgcctggggaaggcgtgaaggagttcaggcacagtctttcagaaacagaaaaactgatgccggaatcccttaccgttcatactctttcatttaaacgggcgtcagaaatgacgagaaacaaacataagtacaaagttgccggcagggaagaggtttctcaaatgatggaagacgcggtagcctggacgaaagagcatgggtacgtgccttattatttataccgccagaaaaacattcttggaaaccttgaaaacgtcggatactctttgccgggacaagaaagcatctacaacattatgattatggaagaggtgcagacgattattggcatcggctgcggcgctgctagtaaatttattgatcgggatacagggaaaattacgcattttgcgaatccgaaagatccgaaatcgtacaatgagcgcttcgagcactacacggacgaaaaaatcaaatatttagagcagatttttgaaaaaacgacaaagcagcactgattacagtgctgctttttttatccctgtttttttgcgggctgaacctcaggcttccatttaaataccttgttcagcaagcggtaaattcgttttgattcctttgtgacaagcggtcccaaaatcgccagaatgaggacatataatgcggcaaacggctttaatgtggccgacagtccgccggctattccgagattcgcaacgataatcgaaaattctccccgcgatacgatcgtcagcccgatattcgatgaagccttatgagaaagccctgcgcgtcgtcctgccaccattccggcgataaaatttcccagaatggtcaaaatcactgcacccaacgcaagccaaaccgcttcaccaagcgaaaacggatcgatactgaggccgaagctgaaaaagaacatcgcaccgaagaagtcgcgaaacggaacaacgaggtgttcaatcctatcggaatgctctgtttctgaaaagaccaaaccgagcagcagcgcgccgattgcttctgctacatgaatcgtctcggaaaacccggcgataaaaaagagcgctgcgaaaatgacgataataaacacttcgtttgagcgaatgtccaacagtttgttcaacagcggcgggagttttcttgctgcgataaaaaacagcagcatataaccgaaggcgatcaaaatggacaagagtgcactccctacggatgtcgcatcacctagtataaggccggaaacaacggacagatatacggcaaggaaaatatcttcaaacatgatgatgccgagaatcaattcggtttccgggttggcggttctttttaaatcaacgagcacttttgcgacaatcgcacttgacgagattgtgatgactcctgcgaggatgaggacttccagaaaggaaaatccagtgataaacccgtaaagcagtccgaggctgaagttaatcaaaatataaatcgtcccgccgaccgcgattgattttcctgatttgattaacttcccgacagagaattcgagtccgagatagaagaggaggaacagtacgcccattcgcccgaaaaactcgatgatttcactgctttgaataaatgttagatcaataatccccattttcggcgcgtgcggtccaacaagcatccccagcacaatcagaaacggaataatcgaaaatttaattttattggcgatcacactggcgattgccacaagcacaagtgcagttccgacttcaaatacaagatggtccatcggggctcacacgccctctccagaaagaaaatcgtgaatcagtttcttcagatgctttctctcacctgagaggacaagggtgtcattttcttcaataatcgaatcggctccgggatttaggagtttttcctggttgtgtttgataatggcaatcacagtgacatcgtaattctggcgaacatcaagctctccgagtgtgcgcccgatcgatttggcgcctttttcgaccttaaaccattcaataataagatcgctgaaggccatttcgatggactctagagcttgcggtttatagaccatgcccccgagaatagctgcaatttgccttgcttcagaatcatccaatgatatatttgaaagaagctcatccgggtcccggtcattaaaccggtaaatttcccttcttccgtcatcatgaatgataatcgtcattttttcgtggcttcttgtttcgatttcaaactttttgccgatgcccggcagatcgttttctttaatattcaatgaaaatccctccgaatgtagtgttggcagtatggggtgagttacaaataaaacttgagcaaattatattcggaggtaattagactggtatttgacagggacggccaaagccttttccagcatgtttattagcggttcgtcaagtggtttgacagagagctgcctgacagactgcgccagcgggctgtactctttgatcagctcagccgggtgcatgctgcccggcgacggcgtttttgccgattgtgtttcctgcggatatgaagtcataggcacatagctgtcagtgcttgcttcaaactgggaaggcagaaccacgtccgaagggggaaagtacaccataaataaacttaatagaaaactgatcagcaatttatccatgttcctttcctcccttctcatcaagatatcccttctttttcactatataaaactttatgtttccattcaaacaatatgcatttttcagtatctattgaccttgaaaaataaaaaggtttatttgaggatggcggggaatgtatatgagaaagaaaaaaagtaagcgcatacatggaggtgctttatatggagtttgttcaatatgcatgtaatggggctgttgcagagattatcctgaatcggcctgatgcccatcacgccctgaatgaacagatgctgtctgaattgaaggaggcagtcgaaatggcggctgcaagcgaggcgctcatcgttctcctgagaggaagcgggaaaggcttttcggccggcggtgatatcaagatgatgacatcagagcatgactctgatcaatttaaacggctgatggatacgattgaggctgtcaccctgaatttatatcagatgaagaaagtgacaattgcagccattcatggcgctgctgcgggactgggcctgagtttggcgctttgtgcggacattgtgctcgctgaaaaaaacgccgtcctcgcgatgaattttatcggcattgggcttgttccggacggcggaggacattatttgctgaagaaaagaatcggtgaagcaaaagcgaaaaaactgatttggagcggaaaaaaactatctgcctcagaagctgccgatatggggcttcttgatgggacatttgccggagatcctgccgaaggcgcaagacccattatcgaaaccctgttggcctcccctcttttggcgatgatcgaaacgaaagctatttttcaaagcctccagattgaagaactgaaaaaagtgctatcccttgagcgcagcgcccaagagagaatgagaaggaccaaggatcaccaagaaggaatccgtgcctttttagaaaaacgggagccgaagtttcaagcgtaacagatcagccggaaagctgatcatctgtgaaacaaaatcagctttccggctgcattgactaaacgatgagtatgactatgaagctctttttcttttaagagggcttcaccatgcgtttttgccgcttcttcatgttctgcctcgaattgctcgtttaccagcgtgttccccgaaggatcaaatacggtaaggaaataatcagccatcaggtttctcctccattttaaggtttatcagtctttcttcatttatattctaaaaaggaaatcaaaatcctttattatgctttatccaaaattagtatataatgggtcagggaaggaggagattcagtgcttacaattgatcacgtaacgaagacatttggagattataaagccgttgacggattggacttagatattccggaacagcaaatgttcggtctgttaggcgcaaacggagcgggaaaaacgacgacgtttcgcatgatcctaggattattaagcattacggagggctcaatcagctggaagggccgtcctgtgaattatcatatcagcaacaaaatcggttatctgccggaagagcggggcctttatccgaaaatgaaggtaagggatcagctcgtctatcttgccagattaaaagggatggagaagcgggaggctgtaaaagagctcgggacatggcttgaacgcttcaatattacagattacgagaataagaaggtggaagagctttcgaaggggaatcagcagaaaatccaattcatttcggcagttttgcataagccggagctcctgattcttgatgaaccattcagcggcttggaccctgtcaatgttgagctgttaaaagaggccgtgatctcgctgaaaaacagcggtgtttctattttattttcaagccatcggatggaacatgtggaggagctttgtgagaacctttgcatattgcagaaaggaaaaccggttgtacaaggcaagctgaaggagatcaagcgttctttcggtaaaaagaatgttaccattcactgcgatgacgatctgcgctttttgcagtcccatgaaggcattcttcaatggaaggaaacggcagacggtgtcaagctgcagattgccaatgaagacatttctcaagagatttttgctatgctccaaggaaaagggtttatcagaaagtttgagcttgaagagccgtcactgcatgatatttttatagaaaaggtgggggccgtctatgaataaattttggatcatgctttctcatacatacaaaaataagattatggcaaaatcctttattatttcgactgtcatcacggtgctgcttgttttagttgtaacgaatctggagtcgatcatttctttgtttcaaggtgacgatgcgaaagaaaaaatcgccgttgttgatgaaacaaacgaattatatccggttttttcaaagcagctgaaagtggtggatactgacggcgatcttgatgtgaagctgtcgaagcaatcggaggatgaggtcacaaagcaagtcaaagatgaatcactcgatggcatgctcatcatcaaacgagatgaaaaagggaccatttcaggaacatttaaagcgttaacgatttctgatgaaagcacgtatcaaacgctgcagcaggcgctgacgcaaaccaaaacagctgtcggaacagcggagctcggcgtgtcgcaggaaacgattagcagcctttatgcgcccgttactgtggggcagaaggcgctgaaagaaggggcaaagtctgaggaagagcttggccagacggtagggcttgtttacattatgctgttcgtcatttatttttcggtgattatgtatgccagcatgatagcgatggaggtcgctacagaaaaatcttcgcgagttatggaaatcctgatctcaagtatgccgccgatccagcaaatgtttgcaaagctgcttggtattgggcttgtcgggatcacacagcttgctattattataggagccggctctctgtcgcttaagctgaaccaaaagagcgaaacggcttcatctgtcggcggattccttaatttgaccgacgtatctgcaaccactgtcatctatgctgtcattttctttttgctcggatactttttgtacgcgacacttgccgcgtttcttggcagtgtcgtcagcagaatagaggacgtgcagcaaacgatcacgccgatgacgcttttggttgtcgccggttttatgatcgcgatgttcggtttgaatgcgcctgacgcaggatttattacggtaacttcgtttattccgttctttacgccaatgattatgtttctgcgcgtcggcatgcttgatattccgttctggcaggcggctgtcggaatcggaatcacactgctcaccattgtcatactggccgttatcggcgccagaatttataaaggcggtgtattaatttacggcaattcaagcgcgttcaaagcgatcaaacaagcgcttcgtttagcgaaaaactgattggaaaacagcctggggattctcaggctgtttctttattgacagaacgtgcattcgcaagaattcggtgctaaaataagggtacttcatcctggaaaggagcagaatgttgactgatctaacctttattcatgcggcagatcttcatcttgacagcccgttttacgggatatcgcatctgccggagccgatttttgcccggattaaagaaagcacgtttgcaagcgtgagacatatgatagacgccgcagtgaaagagcacgttgatttcattttgctggcgggagacctgtttgatgaagccaatcgaagcttaaaggctcagctctttttgaaaaaacagtttgaaagactcagagagtgcgggatttcggtatacgtcatctttgggaatcacgatcatcttggcggggagtggacgccgattgaatggcctgagaatgtccatattttttcgtccgctgttccagaagaaaaatcgttttttaaagaaggcaggcgcatagcaagcatttacggcttcagctatcaagcaagagcagtgacggaaaaccaagccgcccgctatcggagatcaactgacgcaccgtttcatatcggcatgctccacggcacgctgtcaggatctgaaggacacgatccgtattgcccgtttacacatgacgacctcgtgaaaagcgggatggattattgggcgcttggccatatacataaacgccaggttctatctgccgagcatccggcagtcatttacccgggaaacacgcaagcacgccatataaaggagacgggagataaaggttattatctcgttcatgtgacaaacggagatatatcttatgaatttcagagagcgcatgatgtcctgtgggaaaaagcggcggttgatgtgacggaggcaaagaatatgacagccctcttccaaatggtggaggacacgttttcgaagctgcggaaaaaggggagccctgtttgtgtaaggcttgttttacaagggacggcgccggaatggctgctggaggcgccaaaaggcaccttggatgagtttcttgaagctcttcaggaacaagaagcggaagaggaacatttcgtttggcctcttagattggacgatgagacagaaaacgaagcaaacctaacaaaccttgatcctttttttggcggtttatttgaagacattgatcgcagcgatctgtcagacgtgctggaagggcttgagcggcatccagtgtatagaaggcacgcggaccggtttagccaagaggaggtaaaggaaataaaagagcaggcacagatattattgaaaagacagcttaaggtgcttgatacatgaggcggtgacagctttgcgaattatatctttacatatctaccaatacggaaaattttccaatcggacctttcacttttccgcctctcctgtccaagtcatctacggattaaatgaggcaggaaaaacgacgatgatgtcattcattgaaagcatgctgttcggttttccgaaaacgaaaaaatatgaaccgaaaacaggcggtgtctacggcggtgttcttgaagctgaacatcctgagtatggggtgctgaagatcgaacggacgaaagggactgccgaaaaactaagcgtgtacacagaaaagggcgaagtaaagcagggagatgttttaaagcagctgttccagggcacagacaggtcgttgtacaaagccatatattcgttcgacgtattcgggctgcaggaaattcacgcctttaatcgggacaagataggggaatttttgctcttttccagcttgtttggtgctgaagccgtatcgaagcttgattcaaggctgacgaaggaaagcgaaaggctctataaaccaaatgggcgaaaccctcaattgaaccaggagctggaaacgcttaagcagctggcagtgaagctaaaacaggctgaagcagaggaagcgggctatcatcagcttctcggggaaaaacgaatgcttgaagcccgccttgcagccgcggaaaccgaattgaaagagacggcgggacatatccgaatgattgagggagcgattgagcgaaaaccattgctaaatgaaaaagcgacactcgaacaggtgattgcagaatttccggaacatgcaggacaatttcctgctgacggactgcatcagctggaaaaatatgaatcccatcttcacccgaaatcagcacagcttgaggcgcttcgggtgaagatggcggagttggacaaacagaggcaaaagcttatccccgataaagaactattggcgaaagaaacgctgatacaagagctttcggcagcgtttcatatgtaccaatcctgtggagaacagctggcagccattcaggcacagctgcgccaggcgtctgcgcagacagcggcagggctggaacagctcaataaaacggatgaaaatgagctcctgaatatgaacacctcatatgattatgaatggcagcttcagcaagcggtgcagcaatatgtacaggcaagagacagaaaacggcagcttgacgagacatttgaacttgcccggcaagagctggaagacacggaaaaggccgttcgtgccgcttcgtccgcgattcttgaagatagccaaagaaaagataaagaagctgctcttagagcatatgatgaaacacaggggcagcaccaagagcaagcgaagctcagagaacagctaacgttttttgaaagacagcaggctaaacagaaaaagactgtcattgcagttggtatgttgttcatcgttctcttttctctgctgcagcaatggattcccgccataagtttcggtgctgcacttattgtgtattggcttgtatcaggaaaatcgtcttctcgaaacagccgagagacaagacagcccatgacggatatttctccagcagaagctgaaatgcttagagaagcgttatgggaggatgaccgcaataagcagcaccttctcacacagcgtgcagcgctccagcaaaaggaggcggcgtatgaaagggtcatccagcagtttgaacagtgggaagccgaaatggcgccgtcctttacacaggttgagcgttttatgaatgagctcggatttaaggaagatccatcatttttgcttgatgcatacagcttaatgaaggatgttaaaaaagaagtgaagaaaaagcatgagctgaccattgaagcaggcaggctgaaaaagcaccggagaacattcgaagaacgcgtcagtatgcttcttcccgtgaatcagagtcaggatatctccatttcggacgcccttcacacattgcggaaaaacattgaacgtgaaaaagaaattgagaagcaaaaaaaggaaattgaaacagatattcattatacaaaggaacagatgcttgaacttgagcaagaaatacagtatttccacgcacagattgaacagttatttgccgcggctgctgcaaaagacagagatgcgttttttgccatagccgacatcagcaggcaattgaaggatacggagaacaagcttcatcacgtaaacgcacagcttcaaggcgggtacccggaggaacttgaactggcggattccaatacgctttctgaattgaaagataagcaatttgttgagaatgaaagaaaagagcggctgactgaggagatcgagcggctccgcagccaaatcgcactgctctcagtcaaacaggaacaattagaggcttcgggattggtctcagacctcaagcttcaaaccgaaatgcaaaaagatcgtgtaaaagaaacggctaaaaaatgggcctcgatacaaatggtcaaacaggtgatcagaaacaaattggagcggcataaaaaaatcgagcttccgcgccttctagagacggcaggagaattcttccgccctctgactgacggaaactaccaaaccatttatttttccgaaacggatgattcgatcatggttatgcatcgcgatggaactgtctatcatgcggaagagctgtcacaagggacgtgtgaacagctgtatacagcgatccgatttgctttggccgttacgcgccagggtgggtcaaagcttccgttccagcttgacgacagttttgttcattttgatcaggaaaggctgaaacgtgtattacatgttctgtataatttatctgaaggcggtaggcagattttgtattttacatgccatgagcacgtaaaagatgcatttcatagcagccaaatcatccatttggtgtcataaaagaggttctatagctgaaaatcggtatgtgatatactggtattatgtaagatacggagggagctttaatagaatggctaaagggattatgctacatgaggttggcgaacaggtggaccagtatctattgattaaatcctcgacgaaagggattgcaagcaatggaaaaccgtttctgacgctgatgctgcaagaccagtcaggcgatattgaagcgaagctgtgggatgccaagcaaagtgatgaagtgacctatgcgccgcagacgattgtcaaggtcgtcggcgatgttcatcattatcgcgggcgcacccagctgaagctaagaaatatcagaccggtaagcgagcaagaaaacgtcaatatagatgcttttttagaaaccgcgccgattccgaaaaatgaaatgatggataccatcactcaatatatatttgaaatgaaaaatccgaatatccagcgaatcacaaggtttttggttaaaaaacacgaagctgagtttatggattatccggcggctacgaaaaaccaccatgagtttgtctcaggtttggcgtatcatgttgtctctatgctgaacctggcgaaagcaatagcagatttatatccttctcttgatcgtgatctgctttacgccggtgttatcctgcatgatcttggaaaagtgaaggagctgtccggccctgtttccacttcatatacggttgaaggcaatttgctcggccatatttccatcatggtgacagagctttcaaaagcggctgaggagcttcaaatcgattctgaagaggtgttaattcttcagcatttgattttgagtcaccacggcaaagcagaatggggcagcccaaaaccgccgatggtgaaagaagcggaaattcttcactatatagacaatctggatgcaaaaatgaatatgatggacagagcgcttgaacgcgtgaagccgggcgagtatactgaacgtgtatttgcactggaaaaccgttccttttataaaccgacatttcataaataacgtaaaaaggactgatgctgacatattcagctcagtcctttttgatgcgtctttcccgcacataactcgtctcattcccgcatatgctaaagaataaagaatctatgcaaagggggagaagcccgtgttattttttccatggtgggtgtatctttgtattgtaggcatcattttcagcgcatataaacttgtggcggcagccaaagaggaagaaaaagtagaccaggcttttattgaaaaagaaggacagatttatatggagaggatggaaaaggagcgagaacgccgcagttctcagcagcatgaagaagaaaaccaaaaccattccatcgcataaaaaaagctgtgcggctcattgagccgcacagctttttttattatttagaattgcttgaagatgaagaagtgctgttgcttgttgaagatgtattaaatgtggctttcagatctttatcttttacttcgatgtcagccttcttcatgactttttgaacagcttcctgaacggcattgctgtcatttagtttttgttcaagcacttcagatttcagttcttttttcatatcatcgtatttgccgcgttcttcagtctttttgatgatatggtagccaaattgtgttttcacaggatcgctgacttcgtttgttttcaacttgaatgcagcttttctgaatgtggaatccagttgttcgttatcttttgaaatccagccaagttcgccaccgtttgtagctgagcctgtgtctgtagagtattccttcgcaagggcatcaaatttctcgccttttttcagctttttctctatttcctcagctgtctttttgtcagcgacaaggatgtggcttgcgcgaatctggccttttaagccttcccagtattctttaatttcatcatctgttactttgatgttatctttagccgctttttgtgtcagcaattcatattttacttgttctttcaggtaatccttgccatattgcttttcgagggcagtatattgatcgccaagctgcgttttgtattctttcagcttgttgtcaatttctttatccgaaactttatacttcttgtccaatactttttcttgcactagctgtgtcagtacgcttgcgccagctgttttcttcatgtttgtgtaaagctcgccttttgttacatcgcctgcgtctgtttttgcgatgacttctttgtcgccgctgctgcaagcactgagagcgaggatgcttgtagcagtgatagctgctattgcgattttcttcattgttttcaaacactcctaatcattccaaattaaattacctatgcgtatcataacatattgtggctttctgtaaaaagattttaaataaagggcattcgtctagtcaaacttttgctgatgacatacttatatattgatcaagaaaaggaggtatgtaacatgagcggaggatactctaacggattcgcgttgctcgtagtactgttcattttgcttatcatcgtaggtgcagcttacatctactaagcagaccgaggatcgcttgcaacataagcgatcctttattttcactagcgcctaatcgtttcaaacatgaattgcataacatgtaattggtaaataaagcttattacaggaggtgctttttaagatgggtgaagtatttgcaggcggattcgctttattggttgtgttatttattttattgattatcatcggcgcttcttggctgtactaatcaacataaaaaagcatagctgcttaatcagcagctatgctttctttcgtatttacactgtaaaggagatctccacaaacgaagagatcagtaaaattaatatagatacattaataaatcggaataccttatcttgccgctcttcaggaatctctctgacaaggcataatgtattggtgagcctgtttatgaaatataaaataaacacggcagccacgataaaatagaataaaatgatgggagattccccctctctctgaactgtcccatattacattaccaaatatttattaaaaaagatagaatgcaaattgaaaaatcgccaccagcaccagggtttgactacttttcaacaagaatatccaagccgtcagcttcctgatcaataaaagcggttttcggtgcttttatcagcttgagagccagcaggaaatcaggcagacagtagccggcgtgaatgcccgagatcatgcaaaaataatgagcgtgattcggaaatgccagtgctgcgtaaaacaataccggtgtaatcagcaagaacgggctgacgagtgaaatcagcattgttgtttttggtatgcgtttccatgtgcgcatgcgcaatatgtaaaactttttttctatttttctttttttgcagatgattggcaggacatggatgactttatgtgcaaataaaataacgacgagcaaaccgccgaataaagatacatattcatcgcttaagcttgtgccaggccgcagcagctcaaaagctaaaaaggtagatataaaaaccaaaatcataaaacatacagcagttaatattatgcgaacggcgccataatccttcatgagatttatggtcttccagcaattcatcaaagtcatccttccatacatcttgaatagaatctcaaaataatttactcctcccaagagaaaaaatcaatgcttttttaagaaaaaatatcatccggcaggtatttttttgaaacaagcaaacaaactgcgaaatatggggttagaactttcttctcagtgaattatcagctaaaataagattaaagatagaaagaagtggtgtggatggattcgatggatcatcgcattgagcgattagaatattacatacaattattagtgaaaacagtagatatggacaggtaccccttctatgggcttctcattgataaagggctgagcaaggaagaaggggaagcggttatgaggatatgcgacgaattgtcggaagagctggcaacacaaaaagcgcaaggatttgtaacctttgataagctccttgcgctttttgccggacagctgaatgaaaaattagatgttcatgaaacgatttttgccctgtatgagcagggactttatcaagagctgatggaagtctttatcgacatcatgaagcattttgattaactgtttacaggttcaagctcttcagccggttcatccgccgcactgtcctttgcttttttcttcagttttccgtttacgctttcaaagtcattgtcaatattggtgagtgacgtttcgaaaatttccataaaatcatcgccgtagatatggcgtatcatacacatcatttctgccacttcaggaaattttccgaataaatgatacaaaggctgtgaccctttaaaaacagcgttgcgtgtcggatcaaattcctcaagcaagctccagaatacctcggtaccttcctcagtcaattggacatatgtgttccgtttatcattcagccgtttggagaaccttaaatatccccgttcttccagcttttttgaaaagttgaatgcggttgatacgtgcatgaccccgaacttcgcgatttcagaaatggaagctccattcaattgatacgcaatccataaaatatgatgctcattaatattcaggtcatacggtttgagccattgctgccaatccttctcgatcgatttccaaagagccttgctaagctgagccattttctgggtgaagactagagcttctttcacatcatagggcggttccactcgattcattacgtcacctgcttctctttttctttttctctattatgccaataaaataaagattaataaagatgaaaatgtaagaattttttaataaattcacaaaccattgcggcggcagggtttttcggccaaaaaaaatacgggtccacttttggcccgcatttttttcttttgaataggatattagttttgtaaggttttctccagctgtctgattttctcttcgatatcggcaatttctttttgcagatcctgctggtgaggcttgatctcttcctgccattttttaattgacgtttggagctcgccgcccacgtctttaataacatccgtgctttcttttgccgctttgatcagctggtcttttaatgcaagcccgtctgactttaagcgtttgattgtttcttcaaaagaatcataattggttttcattttttcacgcagctgctttcctgaggaaggtgcagtaagaagaaccgctgctcctccgatgatgccgcctacgaatagtcctgttaatagagaacgtccgctcgccattacaatcaccccgtctttttcttcaaaataggattcattcagcatttttcatttttgttgaaagtctgaacttctatacatagcttgctttattttagcatattttttaagtgaaaaggagggagaaggttgtctgtctttttgattgtattatcctgcatcacacttgccttcgcttcaggcgctgtttactatatcaaacttctcagccaggctgcttcttatccgcccaagagggttatccggcagaaagcgcttgtttgttcaaccggaaccgcctttacactatgtcttatctttttcacaaaactcctcgcttaaaacatgctgacatgctgcggacgctctgttcaaaaaacctctcccggaagcggaagaggttttgtgtgacaattatttagcagcttccataaagcttgaacgccttaaaatggtttgcacaatcggataaataatgatcattgagattgtattcagcacagcggccggcagaacaacagccgcgaacaatgcggcgaaaccgcccggtaaaccgacgatcaataaagctgacgatagaaacacaattcctgataagatggtcccgatcactgtcagcacagcggctgcacctgtttttcggctctttctgaacaagagaaacagggagaagaacagaaacgctgatacgggtttatcaatgatgttggggatctgtccggctggaaacgcggttgtaagcgcggaaatgattccggtcacgatcccgatgacgagtacattttgcacccgcgggaacagcagaatgcccatgaacatcatgatcagcatcatatctggtttcatgccgcctaaaaagggcggaataatggaatgaagcgctgcgccgattgcggcaaacagagccataatgactaactcttttgttttcataactatgctctcctctgctaagctttttgccctccaataatatgctcatcatttattgcgaaggctttacagaatgtgttatgcaaacagtataccaaacggacggtttgcatagccagactttttactcattttcctgctggaatttcttcatgaacgcagctaatttttcacagtcttcgagagagaccgcgttataaatagaagcgcggcagcctcccaccgaacggtgtccgccaaggccgatcatcttcgcatcttttgctttctggacgaatgttttcgttaattcgtcatcccgaagcgtgaaggtgacattcatgcgtgagcggctgtcctttctggcatgacctttatagaagccgttgctttcatcaatacagctgtagagaacctgcgctttttgttcattgcgctgttcaacagcttccacaccgccgttttccttgagccattccagaacgaggctcagcatataaatcgcaaatgtcggcggagtgttgtagagtgaatccgctttgacatgtgtggaatatttcaggatttttgggacgttcgcattttcatttttcagccagctttttttcataatgactacagtcacgccggaagggccgaggttcttttgggcgcctccgtagatcacatcaaatttggacacatcgatttttctgcttaaaatatcgctggacatgtcggctacgagcggaataggagaattcggaaactcctgccactgagtgccgaaaattgtattgttggatgtgatatgtaaatatgcgccgtcttttacatccgtaaggtcaacctctggaatatagctgtaattgtctgtttcactagtagcggtgatagacgtgttcccgaacaatttcgtttctgccagtgctttttcagaccaagcgcctgtcatcacaaaatgtgcggttttttcaggtgttaaaaagttcatcggaagcattgagaattgaaggcttgccccgccttgaagaaacaagatatcgtaatcttccggaatgcccatcagttcgattaagaggcttttcgctttttggtgcaccgcttcatactctttgctgcggtgggaaagctccataacagacatgccggattcgttaaaatcaataaattctttctgtgctttttgcagaacttccagtggcagcgctgcaggacctgcgttaaaattcgttgtacgttccattatgatctctccctgttttccacgttaatgtataaaataatacaattatcctatcacaaaaattcagttttttgataaaaaattagaattatcaaaagaaattgacggatgtttgcgaaatgttcacaaaataaaataacctcatcttatgatgaggccaggcgttttgcgatagaggaagagatgttctgcagatcctccggtttataatcatcagcatgcgttttccaaaccgctccgaatccatctccttttccgtagcgagggataatatgcatatggtagtggaacacagattgtccagctttttcgccgttattgttcagcgtatttaagccgatcggttcaaattcatcccggatagcgcgggcgattttcggaacagcatggaaatattgttttgctaattcatctgtaaattcatatacattctcaatatgtgttttcggaatgacaagcgtatggccttttgtcacttggctgatatcaagaaaggcaagtacatgttcatcttcatacaccttcgcggatggaatgtcgccggcgataattttacaaaagatacaattttctgcacaatgcatgagggttcctccttatgaaattgtttagtatgtatacactcatcgtaccacagaaatgcagaaaatagaaaacaggatgaacggcgagcgttcaccctgaatgcagaggaagagcttatatgaagaaaatgtgttatgcctttggtaagcacctcatttgtcaataaaatgaagacttgtttaatgcctaacgattcctgcgataaacacctcatttgacaatttgcttcatacatgaagaattcatcaattcagtgaagagaaatggtttgagcattggacatgtttattttctatccaactgtttctaagacgtctttgacaaacacctcatttttcagttgatatgcttttcctctacaactattatgatgtccagaaccctgtctctttatgacagcaaattcatcatttgttaaaagggaattgtttcaaatcaggccttgtttttggtactatgaagaaaaacactataaggggagaaactatgtctctgctatcggtaaaagacttgaccggcggatatacaaggaatccggttttaaaaaacgtatcattcacccttgaaccgaatcaaattgtcggattaatcgggctgaatggtgctggtaaaagtacaacaatcagacacatcatcgggctgatggacccgcataaaggttcaatcgaattaaacggtaaaacgtttgctgaggatccggaaggctaccgttcacaatttacctatatacctgaaacacctgttttatacgaagaattgacgctgatggagcatcttgaactaacagccatggcatatggactgtcaaaagaaacgatggagaaaaggctgcctccgctactaaaggaattccgaatggaaaagaggctgaagtggttcccggcccatttttctaaaggaatgaagcagaaggttatgattatgtgcgcatttttggcagagcctgcgctctacattattgatgagccttttctagggcttgatccgcttgccattaacgcgctgcttgaacggatgaatgaagcgaaaaaaggcggggcgagcgtgctgatgtcaacacacattttggcaacggcagaacgctattgcgattcgtttattattttacataacggcgaggtgcgggcgcgcggcacgctgtcagagctcagagagcagtttggaatgaaggacgcggcgctggacgatttgtatcttgagcttacaaaggaagacgctggccatgaataatatgcttgatatttggcagtcgcggctgcaggagcatatcaaagaaacaagaacatacatgaaatatatgctcaatgatcacctcgtcattgttttgattttttttctagcgggcgctgcaagctggtacagcaaatggatacgggacattcccgctcactttccatccttttgggtgatggccgtgctgttttcgctcgtgttgacaagctcttatgtgcgaacgcttttgaaggaggctgaccttgttttcttattgcctcttgaagcaaaaatggagccttacttgaagcaggcgtttgtctacagctatgtgtctcagctgtttccgcttattgcgctgagcatcgttgcgatgccgctttatttcgcagtcacaccgggggcttcgctcgtatcgtatgccgcggtctttgtccaactgttgctgctgaaagcgtggaatcaggtaatggaatggcgaacgactttccaaaacgaccgcagcatgaaacggatggacgtcatcattcgctttgcggcgaatacactcgttctttattttgttttccaatctgtttatatgtatgcgcttctcgtctatgtcattatggctgttctttatctgtatatgtcttccgcagcaaaacggaaaacatttaaatgggagagccatattgagtccgaattgagacgaaagcagcgtttctatcggattgccaacctgtttactgatgtgccgcatttgcgaaagcaagccaaacgcagagcttatctcgactttttgctgcggcttgtgccgtttgaacagcgcaaaacatttgcctatatgttcacccgcgcctttttgcgttcgagcgattatttgggcattcttgtcagattaacgatcgttttcgcgctgatcattatgtatgtctcagccagcccgctgattgcagctgttttgactgtgtttgccattttcattacgggcattcagcttctgccgctctttggccactttgaccatctggcgcttcaagagctgtaccctgtgaaaaaagaaacaaagctgaaaaactatttctctctattaaaaactgcacttagtattcaagcgctgctgatgtctgttgcatctgcctatgcagccggcttgaccggttttctgtacgcgctgatcggttctgccgttctgatttttgttgttttgcctgcttatatgacaaccaggctgaaaaagcacggaaagctgtgaactgaaaagaggtaatcaaatgacagataatcagctgctgatgcaggaagctttggaatggaaaatgcattttttgcgaaaggattccatgtttgaacgcttttcgaagcgtgtccagacgaaggtgaatgaacggattcctgagaaaatccatacggtcgtcaccgagagtgtaagaaaaatggtagaagcgacaatggccggctccaatatcatcacttataaaaaggatacaagtgcactgtcgctcagtgaaaaaaatgaattggcgaaaaaaacgattgtttcttatcagaaagtggcagctgctgagggagtcggcaccggagcgggcggcatttttttaggcattgctgattttccgctgctgctttcaattaagatgaagtgtttatttaccttgtcttccatttacggctttgatgtgaaagatgcacaagaaagaatgtttttgctgctcgtgtttcagcttgcgttttcgagtgatgatggccgtaaatcgcttttttctgtcatcgaaaattgggagacggagaaaaagagcatcgactggagagtgttccagcaggaatatcgcgattatatcgacgtcgtgaagctttttcagcttttgccgggcgtaggagcggcagtcggcggaattgccaattataagctgcttgctcagcttggagaaacggcaagacatgtttttcatctgaggatattaaaggaaacagccggagaataaacactccggctgtttttttatagctgatgataggtgatcgcagcgccggcaaggaccttggccgctgtcagcatggctttttcgttgatatcaaatttcggatggtggtgggaataaactcgatctggctgttcgggagctgcacctgtaaagaaaaaagtgcctttcacgttttgtaagtaataagcaaaatcctcgccgcccatttgcggttcaccgtcaatgacctgctgaacgccctcggtattctttgcggtgctcaccaagtggatcgtttcggcaggatggttcacaaccgccggataaccctgttcataggtgtactcataggacgcgccgtgcatgctgcatattccttttacaaccgcttcaatttctttctccagaatgtcccggacattttcatcaaaagaacgcgctgtgccgatgagtactgcttggtctgcgatgacattaaacggattgtcggcgatgaaggagcctgtcgagatgacggcggattgaatcggattgactttgcggctgacaatgtgctgcaaagaggaaacgatttgcgaaccgatcaggacggcgtctttagtatcatgcggatgagcgccgtggccgccctttccgaagactttaatcgtaaatcggtctgccgccgccattacggcgccggggcggcagagaatagttccgagcggctcagttgcccaaagatgagtgccgaatatcacatccgtgttttcgagacagccgtcatcgatcattggctttgcgcctcccggataatattcttctgcatgctggtggatcatcacaaatgttcccttcagttcatgtctgttttggtgaaggaccttggccactgcgagaagagctgcggtgtggccgtcgtggccgcatgcatgcatgacaccaggcactttggaggcgtaagggacatctttttcatcttgaatggggagagcgtcaaagtcggccctcaaagcgactgtagggccgggttcgcttccttctatatatgctaaaacccctctgccgccaacgtttgtgcggattgggactcctaacgattcataataggaagcaataaatgcggcggttttttcttcttgaaatgaaagctcaggatacatatgaaaatggcgcctgatctcaaccatttcttcaaaacagccgtcgagctgtttgtttatctctttctgcagtgtggatatggacaaagccgcttcccccttttctatgttttccatgattgtatagaaaaagtctgaatatttcaactcgtgctgttttaaagcatcatcacagctgcgagggttgtcaccaaaaggccaatcgcgacgggaatgaagttttttctggcaagctcaaaaggatcaactttgcaaatggccgccgcgggaatcaacgcccatgggaccagtgttcctccgcccacccagatggcagagatttgtccgagcgcggtcagaacggcgggatcggcatggagagcggacgaaaagagctttgcgatggagccggcgagagaaatgccagaaaatcctgagccgtcaaggcctgttatggctccagcggcagttaatgcagcggcggcaagctcctttgacataggcatcatatgggataaagcaatgccaagatcgttgacaatgccgtgggaatctttagggagtgaagtgcccagtatgctctcatagcctgagtcgccaagataaaagaaagcggcaatcgggatgacggggccgaaaaccttaaaaccgaacttaaatccgtcaataaaatagccggtgattttttcaagccctttatgcttatacacgaaaaaatgaacggtaaggaggatacagattgcagacccgccaattaacgcggtggcatcatttccttgtaggttaaacaagagcatgcaggcgatatctgcaagaaaggcaagcggaatcaaaaaagccagtatggatcgcaggcgttttggcaagtacagcgagttgtcttgttcgccggaaagaacgggggaaaaagaagcgggatgctcctgttttttgcgttcgcgctgaatcatgataaaggcagctgttgttgttgtcacacccataatcagcacaagcggaatgctggccgagacgacatcaccgactggaatgcctgctgcatctgcagtcagctttggcgccgcctgaatgacaaagtctcctgagagggcaaaaccgtgtccgaataagttcatggccatggccgcggcaagaggcgtcaaaccggcacgtgcggctgcggggagcaggacggcgccgatcaaagcgacacccggagaaggccagaagaagagagaaatggcgaacatcaggcccccaatcagccaataggcagtcacaggccctctcacaaggcttgcaaagggagaaatcatcgcttcatttatccctgtttttgttaacaaatcactcattgaaacgataaagcaaatgatgaaaatcgtgggcagcagttcgccggccgcatagataaagctgtggaataaactgctgacagaagctgaaagtgaatggctggcccatagcgatatgataaaaatgccgaatagagaaataaatgtcgtgtcttttctcagcagcataaataggataattgcaccgataaaaaacacatacagaacatggacagacaaaatcccgacttccatcatcgatcactccttccgcttacagattattcataggcgggcggaaggtgccgggacagaggggagggttatgatggaagatgaacattgatctgtttcagctgctcaatcagatgatgccttaatactctattcgctttttgcagatgttttgggaagcattcaggagaaaaaatgacgcacccttcagcaagccagttttttctataggcgatgatgctttccgatggctctaaatatgaatcatcctcgtgctgcatctcgtactcatcaaatccgaactgaaaaccgcagcacgggcagatttcatgagaatgattgccttcatgatcatatggcggttcagccaatcccttaaacccgcagactgggcaagtatgcttcattttgctttcctcccaataaaataagctgccggacatgccggcagctattcgacagcgaaatatgtggtgacataggaaggccgggagaagatcgacgttgtgtcaattccggcagatgtatcgcgttttttgtgggcttctttgtaagaaccggactgctgccagtcttgaaaggcgctttccgtttcccacaaggtcagaatgacataggtgtcactgtcaagcggacggagcactcgaattgcttcaaagccaggctcgttttcgacttttcccgctctgtttttaaatctgttttcaaacagcggacgcccttcctgagtaacggcaatattgttcaatactgcaaaaccgggatgtttgatctctccgacttggtcaatgacttcataagcgtgtggtgcctggaaaacggtatctccgtttgtttcatgaattaaaatggcgttttcctgcccctgcatcaaaaggatattttctgagggatgcttctgtacgatcgtttttaaaaaatcggctgtcccatatgtaatataaaccttcatatcagccacctcctgcttgctagtatatcaaaacaatggtataagtttctattggcgagtgcttcgaacataattccaaacaatttttcccatactacctttagaaaggcgaggtgagttcatgtttaagataaagaaaaagaaactttttatacctatcattattttagtgttaactgcttttctcgctttaataggatatatttcaattatttttctcggccattatgtcatagatgaaaaaaagcttattcttcatgcttcttcaaaaattgttgatcaaaacggagatgaggttgcaagcctgtatacagaaaatcgcgagccggtctcgatcaatgagattcctaagcaggtcagagaagcgtttatcgctgttgaggataaaaggttctatgagcatcacggcattgatgcaaaatctgtcggaagagcagtgtatcgcgatatattagcaggcggaaaggtggaaggcggaagcacgatcacccagcagcttgccaaaaatatttttctgacacatgacaaaacgtttctaagaaaaacaaaagaagtgatcattgcgatcaatcttgaacgggattacagcaaggacaagctgcttgaaatgtatttaaaccagctttacttcggacacggggtttacggcatacaagcggcgtcccactattattttaataaagaagtaaaagatttgactgtatctgaaggcgctgttttggccgctattccgaaggcgccttctacgtactctccgattttgcaccctgataaaaataaggagcggcgtgatacaattctaggtatgatgaatgaccaaggctatatcagtgcgaaagaggctgtcaccgcacagggccgaacgcttggactgcacgtgaagaaacagtcggaaacaccttggtttgacagctacattgaccttgtgatcaaagaggcggaagacaagtattccatttctggggagcagcttcttcaaggaggatacacgatcaaggtgccgctcgattcgaagctgcagaaaacggcttaccaggtgatgaaagagggtagctattatcccggaacagatcagaatgccgagggaagcgcggtctttattaataacaagacaggcggtgtagaagcggccatcggcggaagggattacacatccaaaggatataaccgtgtcacagctgtccgccagccgggttccacatttaagccgcttgctgtatacggaccggcgatgcaggaaaagaaatttaagccatattctctattgaaggatgagttgcagtcctacggagattatacgccgaaaaactacgacagccggtatgagggcgaagtcactatgtctgacgccattacgtacagcaaaaacgcgccggctgtctggacgctgaatgagatcggcgtcgaaacaggaaaatcttatttgaaagcaaacggcattgatatccctgatgaaggacttgctctcgctctaggaggcttggaaaaaggcgtttcgccgctccagcttgccggcgcgtttcatacatttgccgcgaatggaacgtatacggaacctttctttatctcgagcataatagatgaagacggagaaacaatagccgatcataaagaggaaggaaagcgggttttcagcaagcagacgtcttggaatatgacgagaatgctgcagcaggtagtcaaaaagggaacggccacgtccggcgcctatcacggcgacctggcgggaaaaacaggttctacatcttatacaggcgtctccggcgcgacaaaggacgcttggtttgcaggctatacgccgaaaataaccggggcagtctggatgggctatgacaaaacggatcaaaaccattatttgaaagccgggagctcatacccgacgcggctgtttaaggatattttgacacaggcaggagaaaccggtcatgtgttcacaaagcctaaaaacattaaagacctggaaagcccgattgagttgaagccggtcaaaacactcacagccgattacacatttaaagcagcgggactctttactattgaattaaagtgggacgctcaagaggatgatcgggccgtatacagaatttatgtaaacaaggacggcgaggagacgcttcttgattcggttgaagggaagggaagctatgaaattccttatgccaacttattttcgggcgcgtcttataaaattgtgccttataatacacagacaaaaagagaaggggaaggaaccgattacgttcagccaaaattgttttcctcttaatggaattcggcgattttttgaactttgagctacatttctataccatttgcctaaaacaaggtatagtggaataagtcaagaaatacgaacgtatggttgccgtatgaaaggtggaaatcagatgagtaaacgagaaacgtttaacgagacgtttttaaaagctgcgcggggagaaaaagcggatcacacgcctgtgtggtatatgaggcaagcagggcgctcacagccggaataccgcaagctgaaggaaaagtacggattgtttgagatcacacatcagcccgaactttgtgcgtatgtcacaagactgccggttgagcaatacggagtcgatgctgcaatcctttataaagatatcatgacgccgctgccgtcaatcggtgtggatgttgaaatcaaaaacgggatcggtcctgtgattgatcagccaatccggtctctggcggacattgaaaaactcggccaaattgatccggaacaggacgtgccgtacgtgcttgagacaattaaactgcttgtcaatgagcagctgaacgtcccgctcatcggtttctcaggtgcgccttttacgcttgcaagctatatgatcgaaggcggcccgtcgaaaaactacaataaaacaaaagccttcatgtacagcatgccagatgcatggaatctgctgatgtccaagcttgccgacatgatcatcgtgtacgtgaaagcgcagattaaggcaggcgcaaaagcgattcaaatctttgattcgtgggtcggcgcattgaatcaggcagattacagaacatacatcaaacccgtaatgaaccggattttttcagagctcgcaaaggagaatgtgccgctgatcatgtttggcgtcggcgcaagccatctcgcagatgattggcatgaccttcctctcgatgttgtcgggcttgactggagactcggcattgatgaagccagatcaaaaggaatcactaaaacagtgcagggcaacctggacccgtccattttgcttgcgccatgggaagtcattgagaagaaaacgaaggaaatacttgatcagggtatgaaatcagatggcttcattttcaatcttggccatggggtatttcctgatgtcagtcccgaggttttgaaaaaactgacagcgtttgtccatgaatattcacaaaacaaaaaaatgggtcaatattcctaagcatatcttttggtatcttaatgatatcctgtcaaaatgtttgtatcagatcattaaagagggtgtaaacagtgagtagaaagaaaatggggcttctcgtgatggcgtacggcacgccttataaggaagaagatattgaacgttattatacacatatcagaagaggcagaaagcctgaacctgaaatgcttcaagatttgaaagacagatacgaagcgattggcggcatttcaccgcttgccaaaatcacagaagagcaggcgcataatctggaacagcacttgaatgaaattcaggatgagattacgtttaaagcgtatatcggactgaagcatatcgagccgtttattgaagacgccgtagcagagatgcataaggatggcattacagaagcagtcagcatcgtgctggcgccgcatttctccacgttcagcgttcagtcctacaacaaacgtgccaaagaagaggctgaaaaactcggcggcttaacgattacgtcagttgaaagctggtacgatgaaccgaagttcgtgaaatattgggttgaccgagtgaaggaaacatatgcgtcaatgcctgaggatgaaagagaaaacgcgatgctcatcgtatccgcacacagcctgccggaaaaaatcaaagaatttggagacccgtatccggaccagctgcatgaatcggcgaaattgattgctgaaggcgcaggcgtttccgaatatgctgtcggctggcaaagtgaagggaacacgcctgatccttggctcggacccgatgttcaggatttaacacgtgatttattcgaacaaaaaggctatcaagcatttgtatatgttcctgttggatttgtcgcggatcacttagaagtgctttatgataatgattatgaatgcaaagtggtgactgacgatatcggcgcaagctattaccggccggaaatgccaaatgccaagcctgaatttattgatgctttggcaacagtcgtattaaaaaaattaggacgttaaagaaggcgatgaacatgagtgacggcaaaaaacatgtagtcatcatcggcggcggcattaccggtttagccgccgccttctatatggaaaaagaaatcaaagaaaagaatctgccgcttgaaatgacgcttgttgaggcaagtccgagagtcggcggaaaaatccagactgtcaagaaggacggctatatcatcgaaagagggccagactcatttctggaacgaaagaaaagcgccccgcagcttgttaaagacttaggtcttgagcatttgcttgtcaacaatgcgaccggacaatcctatgtgcttgtaaaccgcaccctgcatccaatgccgaagggcgctgtaatggggataccgacaaaaattgcgccgtttgtttctacgggtctgttttctttgtctgggaaggccagagctgcaatggatttcatcctgcctgcaagcaaaacaaaggatgatcagtcattgggagaattcttccgcagacgtgtcggagatgaagtggtcgagaacttaatcgagccgcttctatcagggatctatgcaggcgacattgacaagctcagcctgatgtcgacattcccgcaattttaccagacagaacaaaagcatagaagcctgattctcggcatgaaaaaaacaaggcctcaaggctcaggccagcagctgacggcaaagaagcaaggccagttccagactttgtcaaccggattgcaaacccttgttgaagagatcgaaaagcagttaaagctgacgaaggtgtataaaggcacaaaagtgaccaagctcagccgtggcggctctggttactcgctcgaattggataacggcgtcacacttgatgctgattcagtaattgtgactgctccgcataaagcggctgcgggaatgctttctgagcttcctgccatttctcatttgaaaaatatgcactccacatcggtggcaaatgtcgctttaggtttccctgaaggctccgtcgagatggagcatgagggcacgggttttgttatttcaagaaacagtgactttgcgatcactgcctgtacgtggacgaataaaaaatggccgcacgcagctccggaaggcaaaacgctgcttcgggcatatgtcggaaaagctggagacgaatccattgtcgatctatcagataatgacattatcaacattgtgttagaagacttaaagaaagtcatgaacataaacggcgagccggaaatgacatgtgtcacccgatggcatgaaagcatgccgcagtaccatgtcggccataagcagcgtatcaaggagctgcgtgaagcacttgcatctgcgtatccgggtgtttatatgacaggcgcttctttcgaaggtgtcggcattcccgactgcattgatcaaggaaaagctgccgtgtctgacgcgcttacctatttattcagctaaaacctccgctttatcgcggaggtttttttgatgtgcaatggcaatattgtgtaaaaaaatgattgaattgaacagcaggttatgatacatttgcatatgtacttaatgactaaaatgttcaaacggtcagtttcgaggtgaatacaatgtcaatagatcgaaaaaagctcattttggaggcggctacaaagtctttcacgcagttcgggtataaagcgacgacaatggatcttgtcgcaaaacttgcgaacgtggggaagggaaccatttatacttttttcaaaaacaaagaagagctgtttgacgagattttcactactttattaaaggaaatgaagcaaaaagcggatgaagcgatggagccgaaccttccgttccatgaaaatgtgcacagagcgctgtttgccattctggagttcaggaaaacacatcagctgacgattaaaattttccaagagaatgccgagattggtacaatggcagttcaggaagtgatccagaaaatggagcgagccatactgtcttatatcaaaagtaagattgaagacgggatcaaaagcggcgcaatcaagccgtgcgaccctgaactgacagcctttgtgatgctgaagctttatatcgcgctcatttttgactgggaaaaacaacaccccccgcttgataaagagacaattgcgggactgcttgaattgtatgttgtcaaaggattgtcagcgaactagataatcctttctctttgcaagaaaatgaccatttttcatgatgagtcagttttagaatggaggcatcaggatgaacacaatacgaagtcagtggaaagacatcgtaacaagtaaaaaattattgattcccatcatcgccattttgtttgtcccgcttatttacagcggcgtattcttaaaggcttattgggacccgtacggcacagttgaccagctgcctgtcgttgtcgtcaaccaagacaagggagcaacgtatgaaggagaaaaacttcaaatcggtgatgatctggtcaaagaattaaaggataataacaactttgattggcatttttccaatgatctcgaccaatcgttaaaggacttattgaatcaaaaatattatttagttgtcgagattcctgaggatttttctaagaatgccagcaccgtgttggacaaaaatccaaaaaaattggatctgaaataccatacaaatgccggttccaactatgtaggggcaacgatcggtgaaaaagcgattgataaactgaaagcttctgtttctaaagaagtgacagagcaatatacgaaagttatttttgataactttaaagatatcgcaaaaggtttgagcgacgcgagcagcggcgcgaaaaaaattgatgacggcacaaaggatgcgaaaaacggaagcgcacagctgaaagaaaatctggcgaagctgaaggaaagcaccgctaccatcagtgacaaaacagcgcagcttgcagatggagcggctcaggtgacgagcggcatccaatcacttgatagctcgctcggtaaattccaggacagcagcaaccagatttatgataaatctagtcagcttgcagcaggatcaggcgaactgacaagcaagatgaatgaacttcttgctggacttcaaaatgtgcagaagggtgcgcctaatcttactaacgggctggatcagctcaacagtaaagcccaagaaggttctgagaaagcagcaaaagcggaaaagctcattaatgcgctcgatttaacgaagcttgaaactgctgtaaacaatctggaaaaatcagaaactgcgatgaaggaatttaaaaaacagctgtctgactttgaaaacagcttaaaaaaccgtgatcaggcattcaaaaatctcatcaattcgagtgatttcttaacagcggagcaaaaaagccagttgatcagctctgttgaaaagcagctgccgaaagttgatgcgcctgattttgatgaaattttaagtgggcttccttcagctgatcagctgcctgacatcgcaacgataaaaagctctcttgaagacgtgaaagcgcaggtggcgcaggtgaaagccatgccggaagctacatctaagctttataacggcgcaaaaacaatccaagatgcaattgacagattaactgagggagctgataagatatacaatggttcacagaagctgacagatggccaaactaaactgacagcgggtatcggtgaatataataagcagttcgcaaaagcaaaagcgggctcagagcaattggtgacaggaagcagccaagtatccggcggattgtttaagctgttagacgggtctaaacaggtccaaagcggatcatcaaaacttgcagacggatctgcatcacttgatacaggtttaggcaagctattggacggcacaggagagctgtctagtaagctgaaggatgcggctgatcaaacaggagatatcgatgctgatgatcaaacatatggcatgtttgcggatccggttaaaaccaaagatgatgccattcattccgttcctaactatggaacagggctgacaccttatatcctgtcaatgggcttgtatgtcggcggcatcatgctgacggttgtcttcccgctgaaggaagcgtcaggacgtccgagaaacggttttgagtggttcttcagcaaattcaatgtcatgatgcttgtaggaatcattcaatcattgattgtggcgacggttcttctattgggaattggtctcgaggtagagagcacgtggagattttacgtgtttacaatcattacgagtctcgctttcctggcgatgattcaatttttggctacaacgatgggcaaccctggacgttttatcgcagtcattattttagtgctgcagctgggagcgagcggaggaaccttcccgcttgaattgctcccgaatttctatcaggtcatccatggcgcattgccgatgacctacagcattaacggattcagagcggtcatttcaaacggtgactttggctacatgtggcagatggccggcgtcttaatcggcatcgccctcgtcatgattgcactaagcattacttactttacaatgttaagccgaaaggaagaaacatcagaagaacagccggcttcataaagaaaaagaacttgtttccttggaaacaagttctttttttgttacattccccatttaattatcaatcctgtataggttaatccgccgccaaacccgaaaagcaaaacgatttgatctttttgcagcttcccggctttcactgcgagatcgagcgccaaaacaattgaaaccgaagacgtgtttccgtaatgctcaacactagtgagcgttttttcaatcgggaacggtgttttttcacaaattgactcgatcatgcgcaagttggcgctgtgaggaacaaaccaatcgagatcatcagagctgagtcctgctttatgtaaaagccgttcaaattcgccagggacggttcttgcggcccatttatatacctcgcgtccgttttgcaccatttttccagaaccgacaagctgcacaccgtttatttcatttcgcagtccggcacgatacaaaatatcgccgccgttcccgcttgttccttgtacagacgcaagaaatcccggcgtctcttcatctcgttccactaacagcgcaccagcggcatcgccgaacagaacgcatgtcgttcgatcggtataatccgttacctttgataacgtctctccggcgatcacgagaattttttgatgaaggccagatgtgatcaatccatttgccaaatggaggccgtaagtcagcccggcgcatgtcgcattaatatccagcgcgccggtgctttcccagccgaaatattcctgtacgcggcatgccgtactcggaaaggcgtaatcggatgtggttgtggcaacgaggatcatatcgacatcatcaagtgttcctttataacggctcttgagattcttcaccgcttctatgcataaatcagaggtaaattgatgttcatctgcaatccggcgttctctcattcctgtgcgctgaacgatccattcatcagaggtatcaacgatcttttctaaatctgcattggttaaacgtctgctcggcgcataggtgccgatagctgtaatttttgcttttgacatatgaatcactccttatgtcagattataacactagatattagtatctggtactaaaaagaaggtttttttacaaaaaaagagaagtgtagaatagggaatctatgaaaaagaaaaaggaggctgaaaaatggtcagtcaagaagcagtagtctttttggcattatccggggctattgcgtttctgttgccaatcgggctgattgtatggtttaagcgaaagtatggcgcctcgcttaaagtgttttttattggcgctctcacgttttttgtcttcgctcagctgctggaaggcggcgttcatgtttatgtactgcaagtgaatgaaatgacgaaagaagcgatgcaacatccattatggtatggcatttacggctgcttgatggccggaatttttgaggagtgcggaaggtatatgatgatgcgattttttatgaagcgccatcatacttgggcggatggtctggctttcggggcaggccatggcgggcttgaagccatcctgattacaggcttgtcctctatctcacttattgtatacgcatttgcaatcaatagcgggacgtttgaacagcttttggtcaatggcgacgtcaaacaggcgcttttgccgatacaggagcagctgctgcatactccttcgtatgaatggatgctgggcggaatagaaagagtcagtgccattgccgtccaaattgggctgtctctgcttgttttgtacgcggttaaaagccgccggccgctgtttttgttgtattctattcttttacatgcactgtttaatgtaccggcggttttatatcagagaggaatcatagagcatgctgcagctgttgaaatcattattgctcttatagcggctttatcagtttattggattgtaaaagcaaaaagggtgtttcaataaaaggtccaagcagcagcaatgcccgcttggaaaaatgtgaatggaaatattcattaagcatgggtcatcagaatatttctgattcagtctttacaatgacagcaagaatgtctgtgttttttacaagagaaacaatggtgtttctttttcttcttctcgcaagggtcatggcattctttctttttcttgcaatggtcgtggaaatctttatcgaaccactcgtcaaagaaccaaaaatcatcgaaccaatcgtgacaacgacatttctgttcatgtgaatgacgacagcacatagaaatccctcctcttcccatgctctctacagcatatgagagattgataggaaaagattggacgggtccctcgggaaaagagtatattttaagtagaatataaaaggaggaatgccctatgacgtccgtacgtaaaacgatggagctcattaaagaactggtatcgatcccaagcccgacaggaaatacatatgaggtgatcaattatattgaaagccttttaaaagaatggaaggtagaaacggttcggaaccacaagggcggcttaattgcaacgcttccaggacgcgacacatcccggcatcgcatgctgactgcgcacgttgacaccctcggcgctatggtaaaggaaattaaagcggacggccggctgaaaatcgatttaatcggcgggttccgctacaactcgattgagggggagtattgccaaattgaaaccgcctcaggaaaaacgtacacaggcacaatcttaatgcatcaaacgtctgtgcacgtatacaaagacgcgggaaaggctgagcggaatcaagagaatatggagatccgcctagatgaacctgttcactgccggaaagatacggaggagcttggcattggcgtcggagactttgtgtcgtttgatccacgtgtcgagatcacatcaagcggatttattaaatcgcgccatttggatgacaaagcaagcgtcgccttattgctccgcttaattcatgaaattcaaacagaagacattgagctgccgtatacaacccattttcttatttccaataatgaagaaatcggttacggcgggaattcgaatattcctcctgaaacagttgaatatttggcggttgatatgggcgctattggtgacgggcaggcgacagatgaatattcagtatcaatctgtgtgaaggatgcgagcgggccgtatcattatcagctcagaaagcatttagttcaattagccgagaagcatcatattgactataagcttgatatatatccgtactacgggtctgatgcgtcagcagcgatcaaatccgggcatgatattgtgcatggcctcatagggccgggaattgacgcttcccatgcatttgaacgcacccataaatcatctcttcgccataccgctaagcttctgtattactatgtacagtcaccaatggtataagggggaggaccaatgaagatttataagctgaaaagcacattcggctgggaaggtgatgacgggttgggagaacagctgattcagcagatccttgccggagaaaaaaccgccacgtgcgcgccgaaatcattgtattcaaaagatgaattgagggacgtttatcaaacagcgggtcagcttgttaccgtttatgataaacatgacaatccaagatgcaatataaaagtgacagatgtctttgaaaccacctttggtgcgcctgatatgaggttagtcaaaggagagggcaatggagaccgaattgaggagtttcaagaagatcatcggatggcatgggcggaactgatcaaaagcggtgaactggagctgaatgaggatactgttttgattacagagttgtttgtgcttgttaaagattaaaaaagcctgcggggcaagaaccccgcaggcttttcattaaccagaaatggttgcgttttgttctgttttcgattgggacataacagtttctgctttcgcaggattaaacatgccttcccatttagacatcacaacggcagcaagcgcgttaccagtcaggttgacaactgtacgtgccatatccatgatgcggtctacgccggcaataaaggcaagtccttcagccggaacgccgatggtgccaagcgttgcaagcaagacaacaaaagaagtaccaggtacggcagccatccctttggatgtcaccattaagacgagcacaagcgtaatttggtgccaaatcgtcaaatcaatgccatatacctgtgctaaaaagagagcggcaatagattgatagagaacggaaccgtctaagttaaacgtgtaaccgatcggaatgacaaatgaaacaatgccttttggacatccgattttctccattttttccataatgcgcggaagaaccgtttcagagctggacgtactgaacgccagtaagatttcgtccttcatgtaagcaaggaacttgaagatgctgatgccggcaatttttgcgacaatcccgaaaataacaattaagaagaaagcaagcgcgacataaaccaatccgacgagctttccgagagagataagagaaccgagtccgaatttagacacagtcactccgataagagcgaaaacgccgaatggcgccactttcatcacaaggtttacaacgtggaacatggcatgggatacaccttcaaaaaaggctaatacaggcttgcctctttcaccgatcgcggaaatacccaatgcaaatagtactgtaaagcagatgatggctagaagatccccttcgaccaatgactggaagaagtttgtcggcacaatatggaggaacgtttccgccactgatttattactttgttctttttcagtttcaacatattgactgatgtccgatttttgagcttcgtgtatattaactcctgtacccggatggaagatgtttgcaagggctagtccgagaataatggcaaaagtcgtgatgatctcgaagtacagaatcgttctgaagcctaatttaccgacttgctttccatttcctgcaccggctacaccgatgattaagctggagacaacaataggaatcactatcattttgattaagcgtaaaaagagatccccgattggctgcaggtaagtaggcaatgctgggttgccataccaaatgacgccaacaatgacacctagaataagtccaacgaatatttgtgtggctaatccaaacttaattcttttcatagattacctcccaaaaaacaaagtatcaacatatatcatgaatagacatatatttaatctcactattagatcaaattataatagataagaaatcaattcgtctatagtaaattatatttcgaaaataaagaatattcaatgacattatgataatcaccagaattatctaaaaacaggtgagctttgacctaacctgactattatttcaaaattaagagatatgtgaaaaaataagaaaatcccacgcgtaaggcgcgggattttcgctcattacaaatcgtttacttttatacagtcattgcagatattaccatagcactcatgctgctcttctatcttttttccgcattccgcacactttttcgaaggcaggtttctaaaaaattctgtgattttccccagcataaccaatccctctttcccctttgtagtgatttcattgtaatataacagataacaaaaatcaataactgttttgatacaatgtttaaaacatgcttttttcaagaaaaatgggtatattgaaggaggatcaatttttttgaaaagataggaggacattatgaaagttacagttatcggatgctatggcggttttccggccgcaaatgaagcgacgtcaggctatttgtttcagtcaggtgattactctctgcttgttgattgcggcagtgccgtattgtctaagctgttcggatatgtgccggcggaaaagctggatgcggtcgttctgtctcattatcaccatgaccatatcgctgatatcgggccgctgcaatttgccaagcaagtcggttcgtttctcggcaaaggagagcatacgcttccgatttacggacatgatgctgatatagaacagtttcaaaagcttacatataaaacacatacaaaagggatcgcctatcagccggatcagccgctggctgccggtccgtttacgatcacctttttaaaaacaattcacccggtgacgtgctatgccatgcggattactgacggcagccacactgtcgtttatactgctgattccagctatcaggattcatttataccgttttcgaaagatgctgatttattgatctcggaatgcaatttttatgccgatcaagacggaacaagtgcaggccatatgaacagcctggaagccgggcgcattgcaaaagaagccggagcgggagaactgctgctgacacatttgccgcattttggcgtgcatgacaaccttcgcaaagaagcgaaaaccgtttttaacggagaagtgaaaattgcgaaatcaggttttgtgtgggaaggataaaggaggagcaccatgttatttatagacaatcaaaatatcaatgatccgcggatcaatcttgctatcgaggagtactgtgtaaagcatttagaccctgaacagcaatatttgctcttttatgtgaatcaaccgtctattatcattggaaaaaaccaaaatacaatagaagaaatcaatacaaaatatgttgaggaaaacgggattatcgtcgtccgccgtttatcaggcgggggcgctgtgtaccatgatctggggaacttgaacttcagctttattaccaaggatgacggggacagctttcataactttaaaaaattcactgagccggtgattcaggcgttacatcagcttggggttgaagctgaattaagcggccggaacgacattgtagtggatggccggaaaatatctggaaacgctcagtttgcaacgaaaggccgtattttcagccacggcaccctcatgtttgattcagccattgatcatgttgtatcagcattaaaggtgaaaaaggataaaattgaatcaaaaggcatcaaatcgatcagaagccgagtagcaaacatcagtgagtttctcgatgataaaatgaccaccgaagaattccgcagccatttgcttcgccatatttttaacacaaacgacattggaaacgtgccggagtataagctgacggaaaaagattgggagaccattcatcaaatttcgaaagagcgctatcagaattgggattggaactacggccgctcgccgaaatttaaccttaatcattcgaaacgttatccggttggatcgatcgatttgcgcctagaggtcaagaaaggcaaaatcgaggactgcaaaatcttcggagatttcttcggtgtcggtgatgtatctgaaattgaaaacctgctggttggaaaacaatacgaacgcagcgtcatcgctgatgtgctcgaaggtgtgaatctcaagcattactttgggaacattacgaaagaggatttccttgatctgatttattaaggcaaaacacatcgtttgaaagagcggttgtgtttttgaaataatggaggcaggagggattcacatgaaagtgtttttaatcggagcgaacggacaaatcggacaaagactcgtctctttattccaagataatcctgatcattccatcagagcgatggtcagaaaagaagaacagaaagcgtctcttgaagctgccggtgcagaagctgtgcttgcgaatctggagagcagcccggaagaaatcgccgctgcggcaaaaggttgtgacgcgatcattttcacagccggttccggcggcagcacaggctatgataaaacgctgctggtggatctcgatggagcggcgaaagccattgaagctgcggacattgccggaatcaaacggtttattatggtcagcgccctgcaagcccataaccgtgaaaattggaatgaggcactcaaaccttattatgtggccaagcattatgctgataaaattctggaagcgagcggtttaacctatacgattatccgtccgggaggccttcgcaatgagcctggaacgggaactgtttcagcagcgaaggatctggagcggggatttatttcccgtgatgatgtggcaaaagcggtcattgcctctttagatgagaagaatacggaaaatcgggcctttgatctgacagaaggagatacgccgattgccgaagcattgaagaaactatgacagtactgacactcagggctttttgctcttgagtgtttttttctgtttctctataatggaggagaaagcttggcttcaataatgaatgactattcattcactttaaggggtgggagaatgaatcttgtttcaaaattggaagaaacagcatctgagaagcccgacagcatcgcatgcaggtttaaagatcacatgatgacgtatcaagagctgaatgaacatattcagcgatttgcggacggccttcaggaagccggaatggagaaaggggaccatctagctttgctgcttggcaattcgcctgattttatcatcgcattttttggcgctttaaaagctgggatcgtggttgttcccatcaatccgttgtacacgccgacagaaattggttatatgctgacaaatggtgatgtaaaggcgatcgtgggcgttagccagctgttgccgctttatgagagcatgcatgaatcgctgccaaaggttgagctcgtcattttatgccagacgggggaggccgagccggaagctgcggacccagaggtcaggatgaaaatgacaacgtttgcaaaaatattgcggccgacatctgccgctaaacaaaaccaagaacttgtccctgatgataccgcggttattttatatacgtcaggaacgactggaaaaccgaaaggcgcgatgctgactcatcagaatttgtacagcaatgccaacgatgtcgcaggctatttgggaatggatgagagggataatgtggtctgcgctcttcccatgtttcacgtgttttgtttaaccgtctgcatgaatgcaccgctgatgagcggcgcaactgtcttgattgagcctcaattcagtccggcatctgtttttaagcttgttaagcagcagcaggcgaccatttttgccggtgtgcctacaatgtataactacttgtttcagcatgaaaacggaaagaaagatgatttttcttccatccggctgtgcatttcgggaggcgcggccatgccagtcgcgttgctgacggcgtttgaagaaaaattcggtgttaccattttggaaggctacgggctctcggaagcatcacccgtcacgtgctttaacccgtttgacaggggcagaaagccgggctccatcgggacaagtatcttacatgtcgaaaacaaggtcgtagatccgctcggacgcgagctgcccgctcaccaggtcggcgaattgatcgtgaaaggccccaatgtgatgaagggctattataaaatgccgatggaaacagagcatgcattaaaagacgggtggctttatacgggggacttggcaagacgggatgaggacggctatttttacattgttgaccggaaaaaagacatgatcattgtaggaggatacaatgtgtatccgcgggaggtagaggaggtgctgtacagccatccggacgtcaaggaggcggttgtcatcggcgtgccggacccccaaagcggggaagcggtaaagggatatgtggtgccgaaacgctctggggtaacagaggaggacatcatgcagcactgtgaaaagcatctggcaaaatacaagcggcctgccgccattacgtttcttgacgatattccgaaaaatgcgacggggaaaatgctcagacgggcactgagagatattttgccccaataaaatgaaaaagcgaagcggttagcttcgctttttcattttcaatcctttgcttcttttttaataatatttagcagcgcctttgtatcatttttgcttaatttgtagtatgtgccatccttcaaaaaaacggcttgctggctgccgtcaatccatagtctgaatgagtcataccggtctttatgaaacttgattgtcccttcgtaatcaggggctgatgttttttctgtcttcacctgttttccctgattcataatatccagcatatctttgacgtgctgtcttttttcaatctcgatatcttcctggccgcttgaagacagtgtgatcaaatccgcgtctaccgattgatacacatcgcctgatcggctgtaaagataaaaaaatgctataaacacaagaccgattaccacgatggctgccactatttttttcatttgcatcactccaaacattgttagttttcccagcgatcgggctttccatgcttaaaagggtggaaaagtgcggaacacagcttggttctaagaatttgaatttatgattacaatagaagtaacgggttgatgtgaggagtgaggcgttatgcgcaagtggattgcggcagcaggacttgcttacgtgctgtacgggctgtttttttattggtattttttcctgtcgggtgattccgcaataccggaagccgtgaaagggacgcaggctgatccggcttctttcatgaagccgtctgagttggcagtggccgagcagtattcgaatgtcaagaattttttattttttatcggggtaccacttgattggtttctgttttttgttctgctggtcagcggtgtttcaaagaaaatcaagaaatggatggaagcggccgtgccttttcgctttttgcagaccgttggttttgtgtttgtgctttcgctgattacaacattggtgacgctgcctttagattggataggctatcaagtatcgcttgactataacatttccacacagactacggccagctgggctaaggatcaggttatcagcttttggatcagctttccaatctttacgctttgcgttctcgtattttattggctgatcaaaaggcatgaaaaaaaatggtggttatacacctggctgttaacagtgccgttttcgctgtttctgttttttattcagccggtcattatcgatcctttatacaatgatttttatccgctgaaaaacaaagagcttgaaagcaaaattttagagctggcagatgaagccaatattccggctgatcatgtatatgaagtgaacatgtcagaaaaaacaaatgcactgaatgcctatgttacaggtattggggccaataaacggattgtattgtgggatacgacactgaacaaacttgacgattcagaaattctgtttattatgggccacgaaatgggccattatgtcatgaagcacgtttacatcggtctggctggttatttgctcgtgtcgctcgccggattttatgtcattgataagctttacaagcggacggttcgcctaacccgcagcatgtttcatttagaaggacggcatgatcttgcggcacttccgctgttattgcttttgttttctgttttgagctttgcggtgacgcctttttctaatgctgtctcgcgttatcaggagaataaggctgaccagtatgggatcgagttgacagagaacagagaagccgctgttaaaacgtttcaggatttggccgtgacggggctgagccaggttgatcctccggtgcttgtgaagattttcagaggcagccatccgtcgatcgtggaacggattcaacatgcggagaaagaagagaatgcgccggaacatcaggatgctgacaaataaaaagaagcaggtatggaggaacctgcttctttttactattattgtgcagctgcttgtacgttgattaacccttttccatagtagaaagagtttccaagatatgttgcagtgctttctaaacgatcacggacttgcgcgtttgtccaagtcgggtgcttagaaagaattaacgctgctgccccggcaacgtgaggagtcgccatggacgtgccgttgtaagcaccgtaagtgcctccaggaagtgtgctttggatggatacgccaggagccatcacatcaagctcagaacctgcgcttgagaatgaagctctttggttgctgctgtttaccgcacctaccgcaatagtagaaggatattttgcagggtagccgactgtgcttgagcttccggacgaaccttcgtttccggcagcggcagcaacgacgataccgctggaaacggctttgtcaacgactgttttcagcgctgtagaaccagtaggtccgccaaggctcatgttgataacatccatattgttggaaatggcccactcaatgccgttaataatccagctatattggccgcttcctgttgaatcaagcacttttactgcatataacgatgcgcttggcgctacgcccagaacaccgattgagttattaagagcggcaatcgtaccggctacatgcgtaccgtgagaactgccgtcctggtatgggtttgtttcagaaggtacgaagcttgctccgcctctgacgtttaagtcaggatgagaagagtcaattccgctgtcgataacagctacttttacgttagagcctgtgtagccttgagagtgaagagccggcgctttaatttgagaaatgccataaggaacagattgcgcatattcatgtgcaatatgatcttcttccacatatgcaacgctcggatcttttttcaattcttttacagctttttcatctaatgttgctgcggccgcgttaacatacttaaattgcttttgaacctttccgcctttttcagaaataacatcctttttcttggcggaactcatggcactcattgtctgtttaaatccgacaatgtatttcttttctgtactgctttttccggcagcctgcgcagacatgttgctgaacgccatcgtaaagattaacgttaacgcaaacaacaagctgatccacaattttttgcttctcactctttaccctctccttttaaaaaaattcagagtagacttacttaaaagactattctgtgaatttattgtaatagatggaataatattttagtagacccatttttttgagatgattttatctctatttaggtatatcatctctcgctatttccgtagagactcgaaataactattttcatacagaaaagaacgaaaatagacatgagtaaatgttcattatgctgaaatgtcatgcttttttaggttaaatgctcctgagtcccggcaaatttctgtcgaaaaaattcgttcaaatgacctgcgtgtgcttccgtgagaacaatggatattatcgtgatattttttcaaagcatgatgataaaagtattctgaaaaataaactttacagaaaagggatagaatgaaaaaattattgggagggaggaagaaataagatgaacattcgccaagcaaagacatcagacgcggcggccattacgccgctgtttaaccaatatcgggaattttatagacaggcatccgatttgcaaggggcggaggcttatttgaaagctcgtttggaaaatcacgagtctgttattttgatagcagaagaaaatggagaattcatagggtttacccagctctatccaacgttttcttctgtgtcaatgaaaaggatctacatattaaatgacttatttgtcgttcctcatgcgcgtacaaagggagccggctgccggctgctttctgccgcaaaggattatgcagaggaaaacggggcaaaatgtttaacacttcagactgagcaccacaaccggaaggcaagaagcttgtatgagcaaaacggctatgaagaggataccggatttgtccattattgtctcaatgtgccggcgaagtgaaaatggcggcttgatgatttggttttttgaacgttcttcggttacgatataaatgaaaaggagtgtgccgaatgtcaacgttatttcaagcattgcaggcagaaaaaaatgccgatgatgtttcagtccatgtgaaaaccatatcaacagaggatttgccgaaggatggtgtcctgattaaagttgcttattccggcattaattacaaagatggtctggccggaaaagcaggaggcaatatcgtcagagagtatccgcttattttaggcattgatgctgcgggtacggtcgtctcttccaatgatccgcgttttgcggagggggatgaggtgatcgcgacaagctatgagctcggtgtctcccgtgatggcggattaagtgaatacgcttctgtgcctggtgactggctggtgcctttgccacagaatctttcgttaaaagaagcgatggtgtacggaacggcgggatttactgcggcgttatcagtgcatcggcttgaacagaacggtctgtctccggaaaaaggcagcgtgctagtcacaggagcaactggcggtgtcggcggaattgcggtatcgatgctgaacaagcggggctatgatgtggtggcaagtaccggaaaccgggaggcggctgattatttgaaacagctcggtgcaagcgaagtaatcagcagggaagatgtctatgacggaacgcttaaggcgctgtccaagcagcaatggcagggagcggttgatccagtcggcggaaaacagcttgcctcgcttttaagcaaaattcaatacggcggatctgtcgcagtgagcggcttaaccggcggaggagaagttccggcaacggtgtatccttttattcttcgcggagtaagcctgctcggaatcgattcagtatactgtccgatggacgtcagagccgctgtttgggagcgcatgtcttctgatctcaagcctgatcagctgctgaccatcgtggacagggaagtatcattggaagaaacgccgggtgcgttaaaagatattttgcaaaatcgcattcaaggaagagtgattgtgaagctttaacaggatcagcttgcagagaatgttatttttctgcaagcttttttgtggacaggatgttcagctgctgaactgctgtgtcgtgaaacaagattttcctgtaagccgaactttctcttctcatttaaaaaataattggtgataatgattctcattccgtgttatactactcttggacatcttaaccatagaaactaccaacaggagagactggaacatatgaaaaaaacactgattattcttacagttttacttctttctgtcttaacggctgcttgctcgtcttcaagcggcaatcaaaacagtaaagaccataaagtggcggtaacacatgatttagggaagacaaatgtgcctgagcatccggagcgggttgttgttcttgagctaggttttattgatacactgcttgatctcggcattacgcctgtcggggttgccgatgacaacaaagcgaagcagctgatcaacaaggatgtgctgaagaaaattgacggctacacatctgtcggcactcgctcacagccaagcatggaaaaaatcgcttcattaaaacccgatttaattattgctgacacgacccggcataagaaggtgtacgatcagctgaaaaaaatagcgccgacgattgcacttaataatttaaatgctgattatcaggatacaattgacgcttcgcttacaattgcaaaagcagtcggcaaggagaaggaaatggagaaaaagctgacggcgcatgaagaaaagcttagcgagacaaagcagaaaatcagcgcgaacagccagtccgtgcttttgatcggaaatacaaatgataccattatggccagggatgaaaacttctttacatcgagacttttaacacaggtcggctaccgatatgcaatcagtacgtcaggcaatagcgattcaagcaatggcggcgactctgtgaatatgaaaatgacactggagcagctgctgaaaacagatccggatgtgatcatcctgatgacaggaaaaacagatgacctcgacgccgacggtaaacgcccgatcgaaaagaatgtcctttggaaaaaactgaaggcagtgaaaaacgggcatgtataccacgtggatcgtgcggtgtggtctctgcgccgcagtgtagacggggcgaatgccattttggacgagcttcaaaaagagatgccggctgctaagaaataaaagaaaagacaggcaaacgcctgtttttttcttatttgataaagccggataagtggctgttgatattatagtcttttatcagccatttttcttctgcaaattcaatgttgctgaggcaggcgttgacgagacgggtgctttgaagctccgggtcaccgccggatatttctgtcagcagggcgtgaattgccgcaccgtgcgccacgatcagcaccttcttgtttggatacgcctggttcacttttgccaaaccgcccatcagcctgtcagtgagttcttctaaggtttccatattcggatagatgttatctggatagcgctttgtccgttcctccagcggcatgccctccgcgtcgccgtaatcgcgttccttaaaatcatccatctcgactatcggaagatgcagatattcattaataatttccgcggttcttttcgctcttttcagcgggctcgtcacaataatatcccaagaaaagtcctttacatattctccggtttctcttgcttggcgttcacctgttgcgtttagcgggatatcggttttgccttggcatttttgctgcaggttccaatcggtttctccatgtcttactaaacaaacggctgtcataaaatccccttcctgactttattcatatcgctattatactaaatcgaaagcgtgtgtcctatgaaaaagcctatgcaagaacttcaaataataaagccagtccaattccgccgccgcttccgatggctgcaacaacatattgacagtctgtccgtcttttcgcttcataaaacaatctggttaccagagctgcacctgatgcaccgtacggatggccaagagctaatgcgccgccgcgcacattgatttttgaaaagggaatgccgagttcttgcgagcagacacaaattttgacggcaaaggcttcattgatttcaaataaaccgatatcctcaggtgttacatcgtgtgtatgtaagagattacggatcgcatcaaccggtgccgcgggcggatagttggggtgaatcccgctgacagcgctgccgataaaccgaagcacaggcttaagtcccagggctgccgctttttcttcttccattaccaaaagagccgctgctccgtctgctatgccactgctgttggctgctgtgactgttccggagctggtgtcgaaaaccggctttgcacggggaataatcgcttctattggccgcgttttcaaaaatgcttcgtccgtctccaattccccgagagcaacaacttcttcacggtaaaatccttcctcatgcgcgttcctgctgcgttgatggctgagaagcgcgtactcatcctgcatgcttctgctgatggaatagcgtgcagccgtatattctgccgcaatgcccatgtctggatcgccgatcgcatctggagaaaagcgagcccgttctgaaaaaggggattggctgctgctttctgagccgcccgcgatatacatcgtgccggctcctgcttgaataaggctgcaggcatagcgcacagcttcaaggccggagccgcactgtctgtcaattgtcattccgggaactgataaaggcagtccggcttgaagggctgacagtctggccaggttgccgcctctgccagtagcgtttccgagaatgacctcgtcaacttgatcctctagctttcggctgagacagcggatgatgggagccgccaaatcctccggcaggaagggcttcagcagtccgttttgatttccaaagatcgttcgttttgcatcaataataaccgcattcatttatactgtacactctcttccagccattttttcactctggaacgggcaatttttccgctgctcgtttccggcaagctgtctgcaaacacccattttttcggaattttataggaggctaatttctgtttacaccaggctttcagtgttctggcattagcgtttccaagaatgacagctacagcgatttctccccaatactcgtcgggaatgccaacgacagccgcgctttcaacctctgggcaggcgagaagcacacgttcaatttcttctgggaaaatatttaatcctccgtacacaatcatcccgttttctcttcctgatatgtatagaaagccctcttcatcaacgtagcccatatcatctactgtcatccattcatctggtgtgctgccgttcacatagccggaaaacctcatcgggcttttgacaaatatttttccgatttctcctggctggcagcgttctcctccagcgttgaggatttcgatccggacattatgaaaagggcggcccgctgaatgcggcttccgtttgctgtcttccggtgaagaaaacgtcacaaaactaagctctgatgtgccgtaaaaatcgtacagcttgagatgaggccatgcagcggcaagcttctccttggattctgccggccagtctgcgccggatgaaatgattttgacgggactgtcgggaaaaccctcaatccttgcgagggcgtctgtcatcgtcggtacggtatagagaacactgatggattcacggcacagccattccttcgctttggcaggagaaaactttttcagcaaacaaacggttcctccaagaaacaaagtgctgactgccccgtataagaagtgagaggacattaacgtcccgggaatcaataccgtgtcatttgatgaaatcgaaaaatctgtttctgtacaggtaaagctctctatccatgagcggtgagatcgcgtaaaggccttcggttttcctgtcgagcccgacgtaaatcccatataaaaagggtgctccggatcaatggtaggcaagggatcagcggttgcttcagaaatatctgccatacagttatccagcaaaacaacaggtgtctggctatctgtcagtttgtttttgaaaaaggctaaagtaaccacaagatccgcattgcttatggacagccgctccttacattcagccgggctccagcgtgtgtcgatgggaatggctgtgcatccagccgctgtggctccggcaaacagctgtaaaaacgccagactatttgggagcaggatcgccacacgattcggcatgctcggctgtgaccgcagccaatttgcggtttgagagacaagccgatcccaatcatggtacgtgatttgctccgattcagtctggatcgctacacggccgggcgatgtttcggcagtagatgaataggtatgagtaattgtcatgtagtgtcatcctccttttgtaaacatcgtatcagaaagagacaaggcttgagtgatttttatcgccagaaatgcagatacagccgcttttatcaaatcaccaggcacatatgcaaggctcatgaaggcggcctgtgacaaatcaatatgcatgataaaagcttgtaccggaataccaagcagataaataaagatgatgccgaatacgatatgagtgaaaaagagacgcaatactgtcaccttccgcagcctgttagcggctaaactgatcagccatgaagcgaggggataagcaatcaaaaagcctgcgctcggtccgaaaaacacaccaaaaccgcctcgtccgccgggcaacagcggcgctccgaaggcgacgagcagcaaaaagacaagctggcttaagaaagcagactttggcctgagaatgctgcctgccaacatgacaccaagtgtttgcaatgtaatcggaacaggtgtaaaggataagaagagagggggcataaagccgagcactgccatcagtgcggtgaaaatcgcaatatgcatcatgtcgattaatttcagcatgtgaaatcctccaaacagtaatcaaatatggttatacaataaatgcaggtaattattatgtcaacttatttttaatttaagtttacataatgaacgcaaaaaaaccggccgtatggcagaccggtttttgatggttattcttctgtcaggatgacaagcgaatcaacggaagcggccacatgggaaacggcgcggctgacttcctgaagccctccaagaaaggcttgcagatcgacgtcgattttgcctgattgctctttgctgattttcatgctgtggacgatttcatcgaataagcggttaatttgcgtcattttttctttactttcgctgactagctcattcacgtctttgatatgcttggatacaatgttgatttgtgtattcgtattgttcacaagctcagaaacagtagagacggtttttttcgtatcctcagaaagcttccgcacttcatttgccacgacagcaaagcctttgccgtgttctccggcgcgggcggattcaatagatgcattgagcgagagaaggtttgtttgttcagctatgcctgtgacgatgccgaagattttttcaatttgctgcgcgatttcatccagcttgaccatttctttttcgatttggacaaggcttgtgtcaattttgttcatctgtttttgctggacttctagctctttttttccgccgatcgacttttcttcaacagtgctggatgttacagtgccggctttggatgcttgagaaatgccttcagatttgtccacaagctcttgaactgatctgcttgtttctgaaaacagattggcaatcgatccagaggtttcttgaattttctgatgaagaaggtttttcttttcttcttgttcatcacgggtctggttgtactcgctttgaaacgcttcaaggacaagctgctgttctaagttcaagatttttgttgttgctttaatggcttttagcagttcttgctgatttgtaatggacgcttcataaatgtcaatcattgacaaaaggagctcttgaaacgcacccatataccattttggcaaaaggccgattcttaaatggatggaggcgattcggttacgcttttcaataaattcatcatcgataacgcctgcaaacatttcctgaatatgccgttttaacgtttgttttaagcggtcaactgagctgtgatcattaatgatatccatcaatgagctttcatggtcaaggtttttataaaacgcatcaacgatatttacgatattttcttgaatgagtggctgaagctgctctaacacgtaaagctcagcatctcccaacctgaccattttgagctgttttttgacatctgcatgtttgtttgtgagctgaatgcggtttttttgctgtccgtttgaatctgaaaagtaagctgtttcttgttttctgtcttttttaaataacaatacaatgatcccccttgggaaaaatataatttttactttttggctttttaagcctttttcttttttatcggccaagagaaacatgaatgaagctgcagatgaaaaatatttgaaaaaccgttcattaaaatgaacggtttaatcgagatctatttgttttaatggtttaatggccggaccctctacaacttcgccagatggcttaaagcgtgatccgtggcacggacaatcccacgtatgctcactgtcgttccactcgacctcgcagcctaaatgggtacaagtcgtatcaacgagatggaggcagcctgcctcatcccgaaatgctcccgctcgcctgccgtttatggtgacggctttcccttctcctggcgaaatgtcttcaaattggacatcaggcttttcaagctttcctttaatcaaatgcttggcgacatcggcattgtaggaaatcactttctgcaacccgggattcagatggaaacgggacggagtgaaaatgctttcgtatggattgtcttttttctccacaaggtctgacaatagagtggctgcgactgctgaggacgtcatgccccattttttgaacccggtcgctactagaatattgtcctcattttccgacatcggcccgataaacgggattttgtcgatcgtcactagatcttgtgtggaccaataatatggaatgctttcgatgccgattgtgctttcggccagttgtctcagtgtttcataatgtgtagacatggcttttccctggcctgttttatggcttactccgctgaagagaatcagcttttcaccgtttacaaccgtatagcggagcgccactgacggctgatcgatactcaaatacatgccctcgggatactcgatcttcggcttgatggcaaggacataagatctgtcggagtacattctcgcagcatataatccgcctccgtcataaaaagggaagtgggaacagcatatgataaagcggctcttaatggcgtgccggctttttgttaccacttcgggcctttcgccttttttgatatcaagcgcaacggtctcttcataaattcggctgcctttttgaacaatttgctccagaagcgcttttaagtattgaagcggatgaaattgagcttgattcttcatgacaagcgccagcttagaacctaagggaattggaagatccttgataaggtctctttcaattccgagctttgtgtatgcctcatgctcggtgcggattttttgaacagcgttttcatttgccgtataaagatatgcgtcttgctcgatccattcacaatcaatttgatgttcatccacaatgccttttatgtaatcaattgcgttttggtttgcttcataataaagcctcgcatggtttaatccgaaatggcggataaattcgtcgtatatcatgtcatgctgtgcggtaactttagcagttgtatgcgcagtggttccgttaagaacctgatttgcttcaatcaaaacgacacggaagcctctcttcgtaagttcatatgccgttgtgattcctgtaatcccgcctccgataatggtgacgtcacattcagtgtcctcttgaagcgcaggaaaagaaggcaggtcagttgatgttttccagtatgtttcaggtgcttcctttgcaaaatgttgattagccaagccgttatacctccaatcagatttattcttaatttttccatattctatcttttcatacataggaagcaggcattgttcataacataataaggttgaaaaggagtgatttcattggcgaatcaaaaaaagaaaacattaccgcctcagcaccagaaccagcagcctggttttgaatatctgatggacccgcgtccggtttttgataagccgaagaaagcgaaaaaattagagggcaaaaccgctattattactggaggagacagcgggattggacgcgctgtctcggtgttattcgcaaaagaaggagctaatgtggtcattgtgtatttgaatgaacatcaggacgccgaggaaacaaagcagtatgtagaaaaggaaggggtaaaatgcctgctgattgcaggagatgttggggatgaagcgttttgcaatgatgtggtcgggcaggcaagccaagtgtttccatccattgatatattggttaacaatgcagctgagcagcatgtccagcccagcattgaaaaaatcaccagccaccagctgatcagaaccttccaaacaaacattttttccatgttttacttaacaaaggcagtgctgcctcatttaaaaaaagggagctctattattaataccgcttcaattaccgcctataaaggcaataaaacgctgatcgattattcagcgacaaaaggcgcgatcgttacgtttacaaggtccctttcccagtcgcttgttcagcagggcatacgggtcaatgcagtggcaccgggtcccatttggacaccgcttatcccggccagctttgccgcaaaagacgtggaagtgtttggttcagacgtgccgatggaacgcccgggacagccggtcgaagtggcgccaagctatctataccttgccagcgacgattccacatacgtcacagggcagacgattcacgtcaatggcggaacaattgtgaacggataataaaaagccaatccttgaaggattggcttattcgctctgcttgagcgctgcatattctttagagagcgtaagaaacgcatctttatctttttcgtccaaggctttgttaatttggtccgtcagcatggcaagccgacggttatacaaggattcatcgagcaccatttgaatgtaaatatccgtcattgtgacatcgaattcttttgttttttgcgtgttgcgggacttcatgagctcagtgtacgattttttctctttcataaagaatccccccaatgccttttttatagtatatggataacggtcgaaaaaatcaataaatttttataatttttagacaactaatacttggcaatctatcgacatatcctgcaaaatgccgtaaaccggcaagtcttatgaaagtaaaatcggtttattactagttatttagtaccattaaatatcattaaaagatgattttatcttaaatgttaaaaaaacctgtcgttttacaaaaacagatgatagattattagtataaattttgcagaaaaaggatggaggccataatatgagtcagaaaacagacgcacctttagaatcgtatgaagtgaacggcgcaacaattgccgtgctgccagaagaaatagacggcaaaatctgttccagaattattgaaaaagattgcgtgttttatgtaaacatgaagccgctgcaaattgtcgacagaagctgccgattttttggatcaagctatgcgggaagaaaagcaggaacttatgaagtgacaaaaatttcacacaagccgccgatcatggtggacccttcgaaccaaatctttttattccctacactttcttcgacaagaccccaatgcggctggatttcccatgtgcatgtaaaagaattcaaagcgactgaatttgacgatacggaagtgacgttttcaaatgggaaaacgatggagctgccgatctcttataattcgttcgagaaccaggtataccgaacagcgtggctcagaaccaaattccaagacagaatcgaccaccgcgtgccgaaaagacaggaatttatgctgtacccgaaagaagagcggacgaagatgatttatgattttattttgcgtgagctcggggaacggtattagaaaaataggaaggagctgaccgaacagggcagctcctttcataaccctatgccgtcggaattcctccggtgattccatatacctgagatgtcacatagcttgaattctctgaagctagaaatacataaacatcggccaattccactggctgtccagcgcgatttaatggagctggcggcgtgccttgtccgaatttcgggatgttttccgtcggctgtccgccggaaatttgcagcggtgtccaaattggtccgggcgcaactgaatttactctgatgcctttggaagcaagctgttttcccagtccgacggtaaagccgataatggcgtttttcgttgctgcgtaatctaacagcatcgggcttggattatagccttcaactgaggtagttgtgataattgaagctccctccggcaaatacggaagcgccgcttttacaacccagtaaagggaaaagacgttcacttcaaatgttttatagatttgttcagtaggcagatcttcgatgttttcgaccgcttgctgtttgcctgcaacgagcgctagcacatcaagtccgccgagttcgtgatgcgactgtttgactagatcttggcaaaaggattcgtcgctcaaatctccggggatcagcactgcttttcggccttctgcttcaattagctcttttacctcttcagcatctggctgttcctcgggcaagtagttaatggccacatcggcaccttctctggcgtaagcaatcgcggcagcgcggccgataccggaatcgccgcccgtgacaagcgcttttcgacccgttagtttacctgatcctttgtagcttttttctccgcaatcagggacaggcttcatgttcttttgcaggcctggcggttcttgatattgttcgggaaattcatcatgaaaaaatgcttttataggattcgtaagatttgaatcagacatcagcaacgctccttttctgtttggtgtacattcgtatgtgtacccctgagcataagcagaaaaacatgttttggcagtttgaatagtgaaggaaaaagaaaacaagaaaaaacaaagccttcttccatatttatcttgtcaaataagactatatgaattatgataaattcgagctataaatcaactaaatattgggtgttgggggagtgaatcgtcatgaaaaaagcggcggcggttttgctgtcactcggtctcgttttcggtttttcatgcggagctgaccatgtggcggaagccaaaacaaaggtgaaggtctataagaactgcaaggagttaaacaaagtatacaaaggcggagtggcccgcacatcgaaggtgaaaaacaaaggcggaaaaacgaagtacaagccttacgtctctaaggacctttatgatgccaataaaaataaagaccgcgataaagatcttatcgcctgtgaacggtaaacaagaaaaagcaatctgatgaccagattgctttttctattgcttaggccgcctgatcggccgcagcgcttttcgccttccttgtcataaggctgactgccatcatgaccgtgatattcaaaagcagggcggcgatgccgacattcaagtcttttgcggcttgcggcagagccggaaataaagtgccgatcgtcgtttccgtcattgtaatataagtaactgctccgacacctgcaataatgccggcgaaagctccttgctttgtcaccatattatgcttgagcaggctgaacaaaagggcggggaatagctgtgtgacaaggctgtagcccatcaaaagcagcgtaacgatggtattcccgcctttgaaggtaaaatacaccgaaatcagcgcaatcaccggcactaaaaacttagcaagcgccgatacttgctgttctgtcgtgcggggcgcgattaccttgtacacattttttgcaaacagcgtggaggcggacattaagatcatagaccctggcacaagtgctgtcagcagtccggcagcaccgataattccgacaaaccaagggtcaaatgcttgcagagacagtctcaaaagcgatagatccccgtctgcgcctttcagatctggaacttgcaggatagccgcaaagccgacgaaaaggacaaagagcaggaccagctggtacaaaggcatgatgatggcgtttttacgaaacacttttgggttttcggctgaatacgaagcggaaaacgtgtgaggccacatgtaaaaaccaagcgctgtcaagagtacggttgaactgaaccaggccacactttgtcccgattcggggagcgtaagaaagccaggctttgccgtttcaatctgctgaaacatgtcttgaaatccgccgtagtaatgaattggcaaatacacacctaaaaacagaacgacaaccagaatcatgatgtccttcacaaccgatatccaggcagacccgtgaatgcctgaaaccataacataaaccgtgatggaaacagcgccgatccagatggcagcggtcggggtgattttgccgtacgaggtttccgatacaatcagcccgaggcctttcagctgcagtacaagatagggaatgagtgcggcgatgccgaccaatgaaacgagaatgccaagtagcggactgttgtatttttttgtgaaaaaatcagactgcgacatcagtttatgctgtttcgcgtacgtccaaactgctggaagaagccagtaagaaaggatgtaggccagacatccgtaggcgatgatataaaaggctggaccgccttttccgtaggcccagccgctgccgccgagaaacgtaaaagtagtataaatttcgcctgccatcaaaaggaagacgaaaacagttccgaagccgcgccctccgaccgtccactgctccaggttcatgtcttttcctttttgggcgcgtataccgagaaaaatactcaagagcaggacaccgaagatgatgatgagagctgcattcattctgcttcctcctttttattttccttgtcgaggacatacacaatcgccatcagcgcagaggtcaaaagagcccacatcacaatataggcaagaataaacggcatgccgaacacatagggggtcaccttatttgcaaaagggatgccgagtaagattccgataaagggcaaagcggcaagaacgtgaatcagtttcatagaatcctccttctatttaggattgggatgtacaagcctaagcgtaatgaaaatgatgtcgcagatatcgcagcacatgtcactttttagggtgaaaggctgtggttcgaattataaataaatttattttgtttgtatagtgtgaattgtctgaaattaatgatctgaatcgcccgaagagggaacgggcagtatgattcaaaaggctcggagtctgtctggggcaaatagatagtatgttaataattcgctgacctgctcacggattcgcggattaaaatagcggtgcttttcttcataaccgtcgatgacaaatgtatagagcgtaaaggcctcatcgcgttccgtctcgcggattgcaatttttcttttcctcagttcttttctgacctccatcaaatccttttgtgctatttttaatgattcgctgataagctgtttataaggatgcttcaattttaatgtgctttcttcaattccggcgagatcacggttaaaaatcgtaatggccatgggcaaaaagagagcccgttcaattaaatcgtatatttcctcctgcagatttggcatattgactccttctttctaagggaacgtttgttctatttgtattctatatcggctggtgaaatgtttcaagacagaaaaaatcaccaaaactttttagttttctgctgataatgtgtagaataaggatagacaaacccggtaaggagtataaatgttggagcattttttatcctatttgacacaagaacatttaactgaattatttcaaagctatagggctttcggtccgctcatagctgtgctgctgcctttaattgaagcatttctcccgtttttgccgctgatcgtgtttgtggtggcgaatacgaactcgtttggcttgtgggaaggattcatcctgtcttgggcgggatcaactgctggttccattctcgtatttttgattgtccgtcaatacggacagagaaaattgcttggatttatccgcagtcatccgtctgtaagaaagctgatgttatgggtggaaaggcacggcttcggtcccatgtttcttctgctttgttttccatttacaccgtcagccgcagtgaatgttgttgctggtttgtcaaggatcggaacgcggccgtttattttggcggcagcctcggggaagcttgtcatgatttttatgatcagcttcatcggatatgatctgcacgcgctgattacacagccgattcgaacggtcatcgccgtattggtgatcactgtcttatggtatgtcggcaaaaaggtggagcggtatctgtatgtaagagccagtcagcgtgagcatgatggagggagacagtaacatgaaaaaacggttttggtttcttgccggtgtagtgtccgttgttctcgccattcaggttaaaaatgctgtctttattgattacaaggtagaaggcgtcagtatgaacccgaccttccaggaaggaaacgaattgttggtcaataaattttcgcatcgatttaaaaccatccatcgttttgacatcgtcctttttaaaggccctgatcataaagtgctgattaaacgggtaatcggcttgcccggtgaaacgatcaaatataaagatgatcagctgtatgtgaacggaaagcaggttgctgagccatttttgaagcatttgaaatctgtttctgccggcagccatgtaacgggtgatttttctttgaaagatgtgacgggaacaagcaaggtgccgaaaggaaaatattttgtcgttggagataatcgcatatacagcttcgacagccggcattttggtccgataagagaaaaaaatattgtcggtgtgatttctgatgccgaataaaaagacgctaattgaagaggcgtctttttgtatgccgtttggaaaaatgtgttgaagaaaaatttgtaaggagctataatcaatattgttacgcgcgtaacaaaaaaacggttgttttatgattatgggttgtttttattagattttgttcgttttgtatgaaacaaaaggagtggtgaatgatgatgaaatatgaagcagtgattataggaggagggccggtcggatttatgctggcttctgagcttgcgatggccggagtaggaacatgtgtgattgaacggcttgaaaaacctgttccgcattccaaggcgttgacgctgcatccccgaacgctggagcttcttgagatgagagggattttagagcggttcgtatccaagggaagcaagataccttccggacatttttcaatgctggatacccgtctggatttttcaggcttggatacgagctgtccttacacgcttttgctcccgcagtcaaaaacagaaaagctgcttgaagatcatgcacgaagcctgggaacagaggtgtttcggggtgcagaggcgctggcggttacgcaaaacggggaagaggtccaaacaatttttaaggatcgggacggcagtgtacggacgatcacaagcaagtttgccgttggtgcagatggcgccggaagtaccgtccggaaacaggcgaaaattgagtttccgggaacagacagcactgtcaccgctgcgcttggggatgtggcgctcctttctccgccgccgtcaggcgtgctgtccctttgcacaaaagagggcggtgttatgattgttccgttatctccagaccgataccgtgtcgttgtgatcagtccttatcgcacgcaaacgccgaaagatgtgcctgtgactgaggaagagctgaaagctgacctcctgcgaatttgcggaactgacttcggtttaaccgacccttcgtggatgtcgcggttcgggaacgccgcgcgccaagcgaaacggtatcgggacggcagaatctttcttgcgggtgatgccgcgcatattcattttccagcgggcgggcaaggactgaatgtcggccttcaggatgcaatgaacctcgggtggaaactggcggcggccatcaaaggctctgcgccttcgtggcttttggacagctaccatgacgagcggcacccggcagctgaagggctcctcagaaacacggaggcacagacaaagctgatcgatttcactcaagcaggcctccatttgcgaagcatgatgtcggagctgctggccttccctgatgtgaatcgatatgtagcagggcaaatttctgcactcgatgtcagatatgaagctgatcgtaccatgccgccgaatcgtttgaacggggcaaggctccctgacatgaagctgattctttccgacggcaattcggaacggctgtacagctttctccaaaacgggacattcgttttgctgtcattgaggcaggaagctgatgatcatatcgaagtgaaaggcttatgtacggtaaccgcctcgcttgcagaaccgaatgaaaagttgcgggatgtgcataccatattgattcgtcccgatggacatgtagcctgggcggtggatgcctcagcgcccgattgtacccaggtgattcaaaaaggaatcagccgctggttttccgtcaccagccgagtataattcaattcgattgtttcatctgtaacaaaacggtatgatagaagaaacaatcgaatgaaaaaggatggaaaacccgatgaacacagatcatacaaaacgcaatctttttgaattgtatgcggagctcattcatcagcaggagaaatgggaggggcttattaaagcctttttatctgacgaattgaggaagctggatgtagagcacgggagtaaatctcaattgacgatgacagaaattcatgttctatcttgtgtcggggacaatgaaccaattaatgtcacgtcgatagcagaaaaaatgaatacgacaaaagcgactgtatcacgcatcagcacaaaattgctcggcgcaggcttccttcacagaacacagctcagcgataataaaaaggaggtctacttccgattgacgcctgctggaaaaaagctgcacagtttgcacaaatattatcatcagaaggctgaacagcgttttctgtcattttttgaccgctataccgaggaagagattctttttgcggaacggctgtttcgggatctggtgacaaaatggtatccgtcgtcagaagaaattgaaggggggcttcctagcatttttaaataaaaaacacgcactgaggtgcgtgtttttcacgtttcttctttctttttcaagattgtaacgtaaatcagatttcctcnnnnnnnnnnnnnnnnnnnnnnnnnnnnnnnnnnnnnnnnnnnnnnnnnnnnnnnnnnnnnnnnnnnnnnnnnnnnnnnnnnnactgtgtttttgatgctttgttttcaagtgaaatagggtcttctgttttagttctcctaatctttacagaaatacctactagaatgaccgccatagttgtaaatattcccatggttaataagatcgtatcctgatttaaactccatccaattaagaaagagatgatcgctcctccgaaacttgccgaggcaataaataaacttgtaacttcgtcaacgtacttctgaataatgattgatgctagtgttaaagcaatgggaaatatacccgctatacttaggccaatcaaaaatgtaccacccaattgaagtattgggttacttatataagagaaggcaatcaacaaaacaattaaacaactacagctaaaaaggaggtatttggaaaaatcgagccttctacttactaaaccaatcaatattcttcctatgatgatccctacccagaaaaaggagacacttataagactaatttgttcattgtcttggtttatcatgattgaaggtaaaaagttggcaaaatttgtttcaattccagcatataggaaagcaaaaaatacaaaaaagcctaattgctttgatttttttctatctcctataaagtattgaaatgctcctccatctggaaaggtcacttgttggttggcattcttagcgtactttcggttcttggacaagaaaattaaccaccctacgaataggacgaataaaaaggtgaatatacagtaatacggtaaaaaccagttattgatatctatgaaggaattaattaataatgggaaagataaagcgcctaatccaaagagaacttccagcttactcattttttctgcattactttcgaaattagcaataacaaatgaaccaactgtcgtttctaatgtgcctgccccatatcctaagagaaaagccattacaataatataataccaatccttagttagaaaaaagatgcttaacgctgcaagcattattgtcaaagctaaagtaagtgtcctaaaatgactgtatttcttaatcattaacggtgcgattaatactccgcttagaaatccggtaaactgaaagaagattatgaccgaaatatcatctgttgtcttgttaaaagactctaatagaaatggtgtcaaactccctgttgatatatggataatgcctactgtaaaaaagaaagcatatccaaataaatatgtccctcttaacattcattacacccctatatgaaaaagcaggaaaataaattcctgcttttttagtaacttctctcttcgaaatactagttgactgctgaaacagacattggttgagagttgctgtctttctcaaagaacatttctaatacttcctgagatctaaaaccatcactaaaagaagggatctcaacccaatcattctgagttgatgcaatccaattgattaactcgcttctaaaagaatcagcccatccataaaactcgtttggcggatcgtttaataggctttgcggtactgggcagtctaccacgttcaagccatctatgagcttgtaaacgtgaggattacctgtgtggtatttaaactcttttttgtgtccaactacctcaatgctaaaaccacagtcttcaggtacagaacattttgatgtgatgatatttacaaataccttgttcttcagctggccataaatttctgcatagtcatctacgagtacctgtttatcctcttttgtttttacatttgtgttcatttttgcccttactgattctgtgatgaaatcactctcaaacaaataccataccatgtcaataaggtgaatacccagatcccccaatgatccactcgtcttcttactgttagcgtcatctctccaagtaaacttcttacgtctaagtgcactatttttcttgaagtgtacttttatggacagtatgttacctagttcattattgataattaagctttttaagatatttacgtaagataaatatctataattaaatcccatactggctcttacgctcaacctttcagcagtatctttcattatgcttgcttcttcaagggaaatagccataggcttttcacacaatacatgcttatgttttcctaatgcttgcaaagcatgttctttatggcaaaagtttggtgatgctacaattaaaccttctgaggcatcaattagttcatctacgttttcaaatgacttcccgccgaaagttttcacaaagctttccgcattttgttgatttatgtcatatacccctactaactctgcattttttattgtagataaagcagttgcttgcgctcttgcaataccacctgcacctatgatgccaatcttcttcattttaatttcctcctcatgatccaattaatttttttaaggtattagtaattccttttgagtactcactatcagttatatggttgtgcaagtttttggcttcctgtgttgcattttttagcagatatccattccctactgtctgtaacatacgaacatcatttccactatccccaaatgcgatagctctttcggtatttaggttgtatttctctaacataaacgttacaatttcattctttcctgtccctatggggataaaatctacatcatagctgtcttctggatcgcctgctaagggattacaccgatttatatttactgaaacgccatattcctcgcagattttttcaattgctaataggtttttcttgtcgtttatttcatcttgttcctgatagtagaagttatgcttataccgtgactttcctaattgagtttgaggattcaaaagaatgttatgattttcatgcagctgtttcacaagtttttcaaccttttctttactaaacccttcatttatgcgactgttccacttgttatcttgctgaccgaagttatgctctgaaaagtacgtaatttcagttccaagatcactagctataaaatgcggaaaatatctaaattttcctcgtcccattttatcgataatagattctatactgctcccagtaacccatccgattattagttccccatctttacttttttgttctaggtagtcttcgagttcataaatgtcttgttgcttttgttcgtcgattgtatgcggaaaatacgtttcatcaaaatcacaaaaaacaatatactgaggatgttcaaccgtggataacgttttatactccgatttcttgcttaataacatgaaacagtccctccattactctgtcttgttcttctaaagtaaatgacggatataaaggcaaatgcagtacctgactatgagccttttccgtatgaaccaatgggagtcctgcatacttgtcctgtactaaaggagttttttgcatatgagacagtattggataatatacatctgtttgaacaccaaaatcttcatttaatttagtcatgatatctgctctatcttctgttctcaccttaataggaaacagatgccatacatgatcttcacttaattctggtaattcaataaagcctttattctgcaactctgctaattgggtaatgtatctatccgccaagaacagtcttttaaagttgtttaatgaaaggtacttcattctctctaaaccaattgctgcctgtaaattgtccatttttgaattaaatccaaaattgatgactttcttattttttacatttacttcaaaaccgtgataactaaattgaatgcattttttagcgagttcttcattatcagttgctattgccccagccttgccacatacacccaaattcttatagggattaaaacttaatgtagtgatgtctgcatactttcctaagtctgtcagtccaattccttggcaggcatcttcaattacttttaattcataacgatttgcgatttgacggatatgctgcatgtctgaatgttttccgtataaatgcacaggtagaataaactttgtataaggagttattgcttcttcaattttgtcaggatcgatgcagaatgtttgtgggttaatatctacatagataggaacgcctcccaaagctaacacagcattttcagtagctgaaaagctattagccggcatgataacttcatcccctgggtttaaccctaaagccaataaacctatcataatagcatcggttccactgctggttgcaattacataccttttatgtaaatatgtagataaaacgttttcgaattgctctaaataggggccactcgtaaattttccagttggcaaaacttcagttaatgtatttaagatatcttccacttcatcattggttattaatctgtctacaggcaaaaaagggactttactgatttcacgatttttttgatagttgaaaaggtcatgttcaatatctatcttttcttttaatacttgtttccaccgctcgtttacaatactgtcttcaataacaagttcttttccttgtacgtcaccttttaagtgttttaatagtgacatgttttctttgcttttacctgaaatcttaacctgtttttgcatgaacagtacctccaatgattttataatctaaaaatttattacaaatttatcctaatttctgaaatcggtaacatgtcaacaacttttttaaggaagggaaaatatgcctacaattgatgaaatagcaaaattatgcaatgtgtctaaaaccacagtgtcaagagtattgaataatcatccgtatgtgtcgaaagaaaaaagagatatgatcttaaaggcaattaacgaacttgactacactcccaattatttagctcggaattttaggagaaataagacacaaacgatagctttatcggttccgagtatcgaccatccattttttgctcaattaataaaaggggtctctcatgaagcactgtttaagaattacaaggtaattgtatttcagaccttttatgacaaacagacagagctagaattattagagttattgaaacataaagaagtggatggtattattcttggaactttagaaaatgaatgggatcagatatcccctttcttaaagtatggtcctatcttattatgtaatgaatatcatcactcagcggacatcacgataattgggtatgatgaatttgaagctacatacatgggggtagtacatttaattgaaagagggcataaaaaaattgggttttgttttgatactccatatagcgaagctcaatgtcagaggaaagagggttatttgaaagctttacaagattacgatttacatcatagaagcgaatggatattcggcgaaatgtttaatatcgaggatggctttcgtgtttttcataagataaaggatctaaaggacagaccctcagcaatatttacaggaaatgatcaagtcgccgcagggattattaaacaggcgatgaaaaatggctttaaagttccagaagacttagctgtaattggttttgacaaccaattgatctgccaagtcgttactccgaccataacaacaattgatatccccgtaatagaattaggtcaacaggctgtgttgaaaatcatcgagtccatttcgggtaatgccactttaaacagaagaattattaaactgccaacaaagcttattataagagaatcaacgtaacgatagatttccctttatcattttatatctttatataagaaaaagaggttattcattttaacctctttttcaatcgtaagtcgtcaattatttctttcatttcaccctctggcagcattcacttcaaacctgatccattaacaacgaaatatccgcttatatttcctcatctcgatggtttgcgaattaaaagttcttgaacccttttttcaactaggcactactgccgctgattgagctctttttgtcttttttttcaccatgaagatggtgaagcaggcgataaaacggcggcagcagggcaataaccagaatgacgcgaatgacctgaaccgcaacgacaaaggtggaatcagcatgtaaggtaactgacgtcgtcgccatctctgcaatcccgccgggcgcaaatgccagtacagaagtgatgagcgaaattcctgtcagctcggaaacgatcacggcgctcaaaaacattgctgcgattaaaccgacggacgagacaaacccgacgatgataatacgggtgacgccggcaaacatgcttttgtacatcttagagccgatcgttgccccgagaaatacttgtgatacatggttagcttgtgacggccaccatgccatcatgtcgtgccctgtcaccgcagctccgccaacatgtacaattgctacaccgagcatgctgccgagcagccatggagctggaaattttaaaaatttcgcagctttgcaagctccccaggcagcgagaataagaatgacggtccacaaaacgggagcgagcctaaaatctgtcgttgcagaagaaattgtctctgttgcggcacttgcggtacgatcttgttttgtatagatcagaatgactaaaaacggaatggaaagcaccacgagcagcacacgcatcatttgaacgaggctgactatagcggtattggcgcctacttcctgtgcgatgctcggcatggcggaaagtccgccgggagcggtgccgacaaagctagtcatcatatccgttttgctgaaacgccaaagcacatatcctgacagcatggccagcaggatagacaatatcagcataacgccgactgaaaaccaatggtctttgagaacagagagaacggataaattcagcttttggcccaattcgatgccgaggatcatctgcccgagggcgagccatcgtcggttaattcctttttggtctggtgccatcatcagccatgccggccgtatcatggcgaggcagcaggcgacaatcagtgttccgatcatccatccaattgatattccggttaatgaaagaataaaccccccggctgcactgattgcgataaaccatagatctttgaggagattttcgtctttcttcaatgtaaaacccttcttcctttttcacgtaacactccaattgttcacgtagtgaatgtatttattactatagtatatttttgttgataaagaaattatgaattattttctataagcgattcacttttcttatgaccttgtgttcgagcttttttattgtgtaagtcagagataaacccgctgccagcagacacacggcgagagcgtaaaaaatcacttctccgccaaatgatgtcaggatcagcccgcctgccagcggtccgattgagcgggatatatcccaatgcagaccatagacagcataaaaccggcccagcaaatgaggcggcgccaatttcgatatgaaggtctggatgtgggttagcccgatgctttcgccaaccgtcattaccgctgccgtcactaaaagcattgtcagggaggttgagcatgcaaaaccggcagccgcaagggagtagcaaatataagtaatgaaaaggattgttttcattgaaagcttttcggtccctttgacaagaggaacttggagaacaaagctgaataaagcttttgccgccgagtagatcgtcagtattgacagataatcagaaaacatgtttttgctgaagagcctgtatgttgtttctgtttgtgcatataacatgcttatggggagagaaagcagcaaaagaagcaggacaggcctgtatatcataaagctcgcagatattttcggggtaacagctgggtgtagcggctttgtctcaggcagtttcagtgcagcgatcagaaagtagataaacaatgccgcagcatctaatgcgaatatccacacggggttatgattgtaaagaagcatccccactagcggccctgccgtcagacccgccgaatagatcgcattgatgaccgcaaacacttccgaacgtctgctttccggcgtgctttcagcgatttgggcgcgggaagcgggaatgtacaacgatcttccgatgccattcatgacatagagaatagcgaaaacatacgcatgcgcagcaaatacaaaccctgtcattgccgctgattgaagaagcaatgcggtcaaaatcgctgtgcgccgcccaatccggtccgccgcctttcctgcagcgagcgtcaggaaaatatcagcaaatggctgaaggctgatgatcagcattggcatcatgatactgccgtttaattgttcatgcagatacagcaccataaaaggtcccatcattgcacctgtcaggcttgtcagcaattcgccgaaaaagcggagccgaacgggagcggtatatctcgattttatagagtgaaaactggtcaacatgtgatcgccgcctttcgctgtttgatatagtagtagtgtatagaaggggcggcggcccaaaaagtgaagaaaagaagagataaaagttccccttttgtcgggaggtgcggggattgaagctgatagagcactacgtggcgcttgtaaaaacaggctgcgccgagtatggacaaatgaacgaaatgacgctcactgagattgccgactgtttattttgtacagaaagaaatgcaaagctcattttacaaaagctggagaacagcaattggattatccggaaaagcggagcggggcgcggccgcaaatctaaaatcgcgtttcttcggaggcctgaggaactgcttcttcaaactgcaaaggaatataccatgtcaggaaagcttaaaaaggcaaaggagctgcttcagcagtatcagtccgcgtttccggggcttcaaaacgaatataacatgtggctttcagaggtattcggatttgtgacggagacaggcgagaatggggcgaaggatgttctgcggctgttcatcacgcccgaatctgtctgcagtttggatccatgccaaatatttttgcggtctgagggccatttcgtcaaacagatatttgatacactcttcacgtttgattcggatatgcaggagccaaagcctcatttggttcatggatgggaagaggtcgaaaaaaaacaatggagattttttcttcgaaaaggtgtgtcatttcataatggacagccgctgacatcgcgggacgttgcgtttacgtttcagcgctttttggaactgggtgacaacccgtataaatggcttctgcacggagtgaaacaagtcttagaaaagggcccttattgtgtggcgctcatactcgataggccgaatgcgcttttgccgtatgctctttgtgatgaacggctgtccatactgccggcagaacagggcggcgggaaaaatggaacagggccttttcaggtgaatcagcaacacagtgggatgcttgtgcttgaagccaatgagcgctacttcaagggacgcccctatttggatcgcgttgagtttgtgttttctgagcaagccggagagatgaacggttttaccattcaagaaaaacaaacatgtcctgagcagcaaactgtttttgatgagcggcatgttcagtatttgtcgctcaatctgaaaaagaaggggcctcttcagcaccaaagctttagaaaagcgctccggctgctgatttcctctgaacggctcgttcgtgaagcgggagggcaccgaagaatcccggttacgtcctttttgcatccgagttcttttgagtgggagggcgtttcgccatctgaattgttgaagaaaagcggttacgagggcgaaacaatcgtgctttataccttttcggaaacggatcatcgtgaggacgccgaatggattcaaaatatttgcgcccaacacggtatcaggcttacacttcaattctgtgatgctgctgatctgcgacggccggaaaccgtgcagatggcggatatcattcatgacagtgcgacgttttatcaagacagcgagtttggttttctgcatttgctgctgtcggagaacagtttcttgtatcagcatctatctgaaaagctgacacagatttgctcaggaatgacagagcggatgttttccatgcctgatcgctgttcgagaatcaacatcctgcgtgacattgaccggcagatgatacaggagctgaacgcgatcccgctgtatcaaaatgtgctccaggtgacatcaagtaaaaatgtaaaaggcctggtgcttgatgaagagggatggattgatttgtactccgtatggctgtccaaataaaaagagggttcttttttgaaccctcttttttacgctgccatgctgcggcattgttcagcacaggtgaagcaggctttcgcacatgcttggcaatgatcatgatcgtgctttccgcattcagtgccgcatgcttcacaaatatcggcgcaaagtgcacaaatttctttcataaacgggctgtccgtttgcatggctttgaccgccagcgcgcaaatatccgcgcattccctgtcaagccggatgcatccgctgagatgatgctgcacgctttcttccaagcatttagtgaaacaatgattgcaagccttcatgcaatcgctgcaagcctcaatacaagcttcagaatattgctccatggttgattccccctgtatggcagtatatggttttatgtttcccggctgcatttgaaaaaaacaggggagtgtgtttttagctaaggggatatgtacatataccctgaacgggtatatctaacgttccatcagatagtataggaaccagacagcgtgattttgttcatcacgtgctgcgcgcgtaaagacgcctttcgcttttaagtttgacgtttcctcggccgcacgcaagtaaaagtcgacggtttcttgttcatctttaaaagcggcgtccagtcctcttgtgaaattgtccgggcattcttccgtttgtttcggcatgatgtgtttgccggtaattgaaccatacagtgtggaaaattcacggaggtggcgaatctcgtcacgcctgatttcttcaatctgttttctgacctcatcgctgtgggcgagttcggcaagcttgcggtagcattgaatggcactgaattctccgttgatggccttctgcaaattccgaatcaaaacaggatcttccctgtatggcaccggatagggatggtagctgtaatgcaaggggattcaactccattcttaggaattgggcttctgtaaaagtatatgttgggcagggagagatgtgcggagataatcagctttttatatgtgaaaaggccgtttttaccaatagatcagattggtcattttcgtcaacattcgataaaatatatagagataaaaagagaggggtcttctaatttgggagcagagtttttagtaggcaggtccgggagtggaaaaacgaagctgatcatcgacagcattcaggatgaattgcgccgggctccattcgggaagccgatcatttttctagtcccggatcaaatgacgtttttaatggaatacgagcttgctaaaacgccagatatgggcgggatgatacgcgctcaagtgttcagtttttcacgattggcctggcgcatcctccagcatacgggaggaatgagcaggccgtttctgacgagcaccggcgtacaaatgctcctgcggaagctcattgaggagcataaacaggagttcaaagtctatcaaaaagcgagtgacaaaagcgggtttaccgcacaggttgagcggatgctgacagagtttaagcgctattgtctggaaccggaggatatccgccggatggcggaaagcggaacggcttccgagtatcgcggagaacgtgttttatctgaaaagctccatgacttatcaattctgtatcagcaaatggaaaaaagcctcgcagatcaatatcttcactctgaggattatttgacattgctggcagagcatatcccgcttgcggaagatataaaaggcgcctatatctatgtggatggcttttatcagtttaccccgcaggaattcagggtgttggagcagcttatggttcatgcggagcatatcacgttttcgctcacagcggacaagccgtcatatgagcgggagccgcatgaactggaattgttcagaatgacggggaaaacctattaccgcctgcatcagaaggcgaaggaactgaatttggacattacgtataaagagctgagcgggactgagcggcatacaaagacgccggaattggcgcatctagaggcacagtatgaagcgcgtccggccattccatacgcagaaaaacaagaagcccttactgtgatgcaggccgcaaacagaagagctgagctggaaggcattgcccgggaaattcacgccctagtcagagagaagggatatcgctataaggatgtagccattcttgcgcgccagccggaagactacaaggatatggtgaaggaagtttttgcagattacgagattccttatttcattgacggaaaagcatctatgctgaaccatccgttaattgaatttatccggtcaagccttgatgttctgaaagggaattggcgttatgaagcggtgtttcgctgcgtgaaaaccgaactgctattcccgctcaatgaaccgaaggccaaagtgagagaacaggtcgatcagctcgaaaattactgtatcgcctatggtattaaaggcgaccgctggacaaagggcgatcggttccaatacaggcgttttgtgtcattggatgatgattttgcgcagactgatcaggaaatcgaaatggaaaacatgttgaatgacacccgcgattggattgttccgccgctttttcagcttcaaaaacgcatgaaaaaagcgaagacggttcaagagaaggcggaggcgctctattgttatttagaagagacggatgtgccgctgaagctggatcaggaaaggcagcgtgctgaggatgacggcagaatcattgaagcgcagcagcatcagcaggcgtgggacgcagtcattcagctgcttgaggagtttgttgaaatgatgggagatgatgagatttctcttgatttgtttcagcaaatgatagaagccggcgcggagtcgcttacattttctctaattccgcctgcgcttgaccaggtgtttgtcggcaatatggatttgtccagaatgtatggcacctcctgcacctttgtgctcggggcaaacgacggcgttctgccggcacgccctgatgaaaacggagtcctgtcggatgatgaccgggaatggctgaaaacgattggggttgagctatcctcaggcggacgggagcgtttgcttgatgagcatttcctcatctacatggcgttttcaagtccgtctgaccggctttacgtatcgtatccgattgctgatgcggaaggaaaaacgcttttgccgtcgatgatcgttaaacggttggaagaactgtttccgcatcataaggagcgcctgttaacaaatgaacctgaacaggtcagcgatgaggaacagctgatgtatgtcgtgaataaaagcgtggcacagtcctttaccgcgagccagctcaggttatggacacgggaatacgacatcagcgacgtctggtggagcacgtacaatgtgctgatgagtgcgccggacaggctgcagtcgaaaaagctgttctcaagcctgtttttccggaatgaagtgaagcagcttgaacgcagcgtgtcgagacagctctatggtgaacgcattcagggcagtgtatcgagaatggaaacctttaacgcgtgtccgttttcccattttgcgtcacacgggctgcatttgaaggaacggcaattcttcaagcttgaagcaccggatatcggccagctgtttcattccagcttaaagctgatttcagacaggctgcgtgagcaaaagctggattggcgcgatttaacgaaagagcaatgcgagctgttttcctatgatgcggtagaacggctggcaccgaaactgcaaaaggaaattctgctcagctcaaaccggcattattatgtgaaggaaaaactgcaaaaaattgtgacacgtgtgtccggcattttaagcgagcatgcgaaagcgagcggattcgtaccgatcgggcttgaactgggctttggaggaaaagggccgcttccgccgctgacctttcaactgaaaaacggctgtacgatggaactcgtcgggcgaattgaccgtgttgataaggctgaaagctcaaaaggcctgctcctcaggattgtcgattataaatcaagcgacaaaggccttgacttagcggaagtatattacggattggcactgcaaatgctgacgtaccttgatttatcgattacacattcagctgactggctcgggatgagggcgacgcctgccggagtgctgtatttccatattcatgacccgatgattcaatctaatctcccgcttgggcttgacgagattgaacaggagatctttaagaaatttaaaatgaagggcttgctcctcggtgatcaggaagtggttcgcctcatggatacaacccttcaagagggacgttcaaatatcataaacgccggcttgaaaaaagacggatctcttagatcagactcggcagcagtcggtgaaaaggaatttgatcttttgacaaagcatgtgcgccgcaccttccaggaagcgggcgaacaaatcaccgacgggcgcgtatccattgagccgtacaaaatgaagaacaagacgccgtgcacatactgtgcgtttaaatcagtatgccaatttgatgaatcactggaagaaaacgagtatcgcccattaaaggctgaaaaggacaagacaatacttgagtggataaaaaaggaggcggatggcaatgaacattcctaaaccggcagacagcacatggacagatgaccaatggaatgccattgtttcaaccggccaggatattcttgtggcagcggctgcgggctctggtaaaaccgctgtgctcgttgaacgaatgattcggaaaatcaccgcggaggaaaacccaatagatgtagaccgtcttctcgttgtgacatttacaaacgcctcagcggcagagatgaagcaccgaatcgcagaagccttggaaaaagagcttgtacagcgccccggctcgctgcatatcagacgccagctgtctcttttaaaccgggccagcatttcgacgcttcattccttttgcctgcaagtgctgaagaaatattactacttgatcgatcttgatccgggctttaggatagctgatcagacggaaggcgagctgctcggtgatgaagtgcttgacgagctgtttgaagacgaatatgcaaagggtgaaaaggcattttttgagcttgttgaccgctatacgacagaccggcacgatctggatctgcaatttctcgttaaacaggtgtacgagtattcccgatcccatcccaaccccgaggcgtggctggaaagctttgttcatttgtatgatgtatcagaaaagagcgccatcgaggagctgccgttttatcaatatgtcaaagaagatattgcaatggtgcttaacggggcgaaggaaaagctcttgcgcgcgcttgagctgacgaaagcgccgggcggcccggcgccgcgtgctgacaattttcttgatgatcttgcgcagattgatgaactgattcagcatcaggacgatttcagtgaactatataagcgggtgcccgccgtctcttttaagcgtgccaaagcagtaaaaggggatgagttcgatccagcgctccttgatgaggcgacagatttgagaaacggcgcaaaaaaactgcttgaaaagctcaaaaccgactacttcacgcgaagtcctgaacagcacttgaaaagcctagccgagatgaagcctgtcattgaaacgctcgtacagcttgtcatcagctatggaaaacggttcgaagccgcgaagcaggaaaaatcaatcattgatttttctgatttggagcattactgtttagcgattttgacagctgagaatgacaaaggtgaacgtgagccgagcgaggctgcgaggttttatcaggaacagtttcatgaggtgctcgttgacgaatatcaggataccaacctcgtgcaggaatcgattctgcagctcgtcacaagcgggccggaggagactggtaacctgtttatggtaggagatgtcaaacagtcgatttatcgattcaggcttgccgagccgcttcttttcctctctaaatacaaacggtttacagagagcggagaaggcacggggcggaaaatcgatttaaataaaaatttccgaagccgggctgatattttagacagcacaaactttttatttaaacagctgatgggcggcaaaatcggtgaggtcgattatgacgagcaggctgagctgaagcttggtgcagcgtatccggacaatgacgagacggaaacagagctgctgctgatcgacaacgcagaagatacggatgcaagcgaggaagcagaagagcttgaaacggtgcagtttgaggcaaaagccatcgctaaggaaattcgcaagctgatttcatcgccatttaaggtgtatgacggaaaaaagaaaacacatcgcaatattcagtaccgagatatcgtgattttgctccgttcgatgccgtgggctccgcaaatcatggaggagctgagagcacatggcataccggtttacgccaatttaacgtcaggctattttgaagcggtcgaagtcgccgtggcgctttctgtgctgaaggtgattgataatccgtatcaggatataccgcttgcctctgtgctgcgctcaccgattgtcggagcagatgaaaacgagctgtctttgatccggcttgaaaataaaaaagcgccgtactatgaggcgatgaaagactacctggctgctggtgaccggaacgatgagctttatcaaaagctaaatacgttttacggacatctgcaaaaatggcgcgcgttttcgaaaaaccactcagtatctgagctgatttgggaagtgtaccgcgacaccaaatatatggattatgtcggcggcatgccgggcggaaaacagcgccaggccaatttgcgtgttctttatgacagggcgcgtcaatatgaatcaacggcatttcgcggcttgttccgtttcctgcggtttatcgaacgcatgcaggagcggggcgatgatcttggtacggcgagagcgctcagcgagcaggaggatgttgtccgcttaatgacgatccacagcagcaaagggctcgaatttccagtcgtgtttgcagcaggtctcggccggaatttcaacatgatggatttaaataaatcgtacctgctggataaggagctcggatttggcacgaagtatattcatccgcaattacgcatcagctatccgacacttccgctcattgcgatgaagaaaaaaatgcgcagggagctgctgtcagaggaattgcgtgtgctctatgttgcattaacgagagcgaaggaaaagctgtttctgattggctcatgtaaggatcatcagaaacagcttgcaaaatggcaggcatccgcgtcccaaactgattggcttctgccggaatttgaccgctatcaggcgaaaacgtatctagatttcatcggcccggctcttgccaggcacagagacttgggggatttggctggtgtgccagcacacgctgacatctcagatcacccggctcgttttgccgttcaaatgatccattcctatgatttgcttgatgatgatctggaagaaagaatggaagaaaaaagcgagcgcctagaagcgatccgccgaggtgaaccagttcccggctcgtttgcgtttgatgaaaaagcccgcgagcagctgagctggacatacccgcatcacgaggtgacgcaaattcggacaaagcaatcggtttctgagatcaaaagaaaaagagagtacgaggatgaatacagcggcagggcccctgtaaaaccggctgatggaagcattctgtacagacgtcccgcttttatgatgaaaaaaggcctgacagcggcagagaaagggactgccatgcatacggttatgcagcatatcccgctgtcacatgtgccgtcgatagaagaagctgagcagacggttcacaggctttatgaaaaagagcttctcactgaagaacaaaaagacgctattgatatagaagaaatcgtgcaatttttccatacggaaatcggcggacagctgatcggcgcaaagtggaaggacagggaaataccattcagcttagcgcttccggccaaggagatctatcctgatgcacaggaggcagatgagccgcttttagtgcagggtatcattgactgtctctatgaaactgaggacggattatatctattggattataagtcggaccggattgagggcaaattccagcatggatttgaaggagcggccccgatcttgaagaaacgatatgaaacgcaaattcagctgtacacgaaggcagtggagcaaattgcaaaaacaaaggtaaagggatgtgcgctttatttctttgacggagggcacattctgacattatagcgagatccaaaagctccggaatttcaggcggagcgggtctcgttttctatataaaagagaggtgaaagcatttgcggattttacatacggctgactggcatcttggaaaaacgcttgaaggaagaagcaggctgagtgaacaggccgatgtgctggatgaaatgaatacgattgtaaaggatgagcagatcgatgccattgtaatggcgggggatgcatttgacaccgtaaacccgccagctttagccgagcagctgttttatgaaagcctgtctgcgcttagcgacagaggaaagcgcccgatcgtagtcattgccggaaaccacgataatcctgaccgtttgtccgccgcttcaccgctgacacatgaaaacggcattcatttaatcggttatccgacaacagagccgattcatattgaagtgccttcagcaggagagcttttggcggttggagcgctggcgtacccatctgaagcgcggttaaatgaagtgctatccgatacgtttgatgaaaagctgctccgtgatcactatgatgtgaaaatcaggcaggcgtttgagcatatgacaagccggttccggaacgatgcagtgaagattgccgccagccatatttatgtggcaggcggaaaccaaaccgattcagagcggccgattgaagtcggcggtgcatacacggtggctgctgaaagcctgccggcagatgccgcttacgttgcgctcggccatttgcatcgcccgcaaacgatcaagcgggcgcggacgcttgcgcgttattcaggatctccgctcgcctacagcttttctgaagcgggctacgctaaatcagtgacgattgtggacgcaaagcctggggaagaggccacttggcaagaggtgttattatcaagcggcaagccacttgtgaagtggaaagcggcaaatggattaaatgaggtgtacagctggctggatgaaggcagagatcagaatgcttggattgacctggaaatccgtgtcgcggaccagctgtcacttgaagagattcacaggctgcggaaggcgcacccgggctttatccatatcaggccggtttttgaagaacagaagagagaccgggaacggatcgaggttaagcatgtatccattgaagaccggtttaagaaattttatgaaaaacaaactggcggtgcggtgccggatgaagaaatggtgaagctgtttttagagcttgcatcaggcgttgaagaggaggatgcgaaatgaagccgatcgccttaagcattaaggggctccacagctttagagaggagcagacgatagattttgaaggcctttccggtgccggtgttttcggcattttcggcccgacaggaagcggtaaatcctctattctcgacgcaatgacgcttgctttatacggaaaggtggaacgggcggcgaataatacgcacggtatcttaaaccaggcggaagatacgctgtctgtttcctttacctttgcgcttcagacgaatcaccaaatctcatacaaagtcgagcgtgtgtttaagagaacggatgaaatgaaggtaaaaacggcactttgccgcttcatcgaaatcaaggacgagcatacggtgctggctgataaagccagcgaagtgaataaaagagttgaggagctcttagggctgacgatcgacgattttacgagagcggtggtgctgccccaagggaaatttgctgaatttctgtctttaaaaggggcagagcgcaggcatatgcttcagcgtttatttaatttggagcaatatggagacaggcttgtgaaaaagctgagacggcaggcgcaggaagccaatgcgagaaaaaatgaaatgcttgctgaacagtccggtctcggtgaggcgagctcagaggcagtggagcaggctgaaaaggctctcgaacaagctgaagcccggctggaagcgatgaggaagaaccgtgatcaggcgaaggagcggtttacagagcatcaggagatatggaatgtccaaaaggaaaaatccgcttatgaagaagaggaaaaacgtctcgcagaagaacagtcgcatatagacagcatgcaaaaacgcctgctggaagcagaaacagcagcagcccttaagccctatgcggaccggtacgcagaagcgatccagcatgaggagcaagctgaaaaggaacaaacgctagcccaaaaggatttagcagaccggacagctttctttcagcaaaaacatgaagagtatgaagcgtggcgccagcataaaagcgagaaagagcctgagcttttaacagagcaggaacagctttcacgcttgcaggaaatcgaaatcaaactgagtgaggccaagcaagaggaagagcgcaaaaaggctgaccttcggcagaaagaagaggctcttcaatctgtcatgaatgaattggagacggtaacagaccgcctgacacgagggcaaaacagacagacagaattgaaacagcagctcaaatccctgcaggtgacatccaatgagcgaaaaagctgccatcaggctgcagaaatggcattgcgcatcagacaaaccgaggagcaaatcaaaaaagagaaaaaacgaagtgaagaattgaacctcgtgctgcagaagatgaatgaagagaagaatacactcgttcaaaagacggaagcggaagaaaacaacatcattcaggcatatgaggctgtacaaactgtgtaccatttggtgtgcgaaacggaacgctcattaacacgtatgacggaagaaactagaaagagccaacacacgcttcacttacagcgtgaaaaagcaagggtggcactgctgacaaaagagttagcccaaaagctgactgccggtaagccttgcccggtatgcggttcaaccgatcatgatccatctgcctcagtacatgaaacatatgaagccgacagccatcttgaagaggacattaaacggacagatgtgttattgacggaagctgcagctctcagccaggagattctttcagccaaaattacgcttgaagaacagtccgcgcgctttattgaacagtgtccgtttttgcagacaattcaagcgcagaaccttgaagcggcagcttccttcgaaaatcagccggtgtatgaagcatttgaaactgtcaaattcgaatggaaacgaatcaagcaggacattctttctgttaagacacgaatggcacaaatgatcggcgcctatcaggaatctttaaaaaaggccgagcagcttaatgaaaaaatcggttttgaaaaaagagaagctgaccgtattgaaagcatcatcagcgagcttcaatcctcaatggacagcagtctgaacatgtttaaagaagcatttcagaatcaatctgtggacgaagcagaaaaatggcagcaagccattgaagaaaaggaccgggctgcagaagaatgtgaaaaacgaattgagaagagtatcgcgtttcttgctgagcatgaagcacaaaaggaaaaactgcgggaatcgggacaccggcttgaacgggaaaagctggagcttcattatgcggctgaacgcatcaagagcgtgatagctgattatgagcacgaactcggagattatgcaaaaggagattcgattcaaatcaaactccgctctgtccagcaggatctaaagctgttaaaggaaaaagaacaatctttatatgaagaactgcaaagcgcccaaatgaagctcaaccaggcgaaaagccgcgcttcggcaagcgagctcactcttcaagaggcgaagggcagattggaaaaagcaaaagctgcttggcttgagcatacaaaaaacacctccattacccggactgaggaggttgaacaaagtctcatcccagctgatgaacttgaaaagatgaaaaccggcatagaccagtttatggataaactgaagcaaaatgctgcaaacttaaaacgagtagcagagatacttgccggcagagcattatcagagagcgaatggaacgaaaccgttgcagcattacaaaaagctgaggacgcatttggcgctgctatagaggaaaaaggcgcggcagcaaaagcactggctgtcattcgcgaccatcataaacggtttaatgaaattgaagctgaactgaaaaaatggcagacgcatatcgacaggctggacaagctgcaagctgtgtttaaaggcaataccttcgtcgaatttttagctgaggagcagcttgaaagcgttgcgagggacgcttcagcaagactcagtatgctgacaagacagcgctatgccatcgaagtagattcagaaggcggcttcgtgatgcgggatgatgcgaatggaggcgtaagacgcccggtttccagtttgtctggaggagagaccttcctcacctcgctttcacttgctcttgcgctgtctgcgcagattcagcttcggggggaatacccgctgcagttctttttcttagatgaaggcttcggcacactggatcaagatctgcttgatacggttgtaacggctttagaaaaacttcagtcagacaatctggcagtcggtgtcatcagccatgtgcaggaactgcgtgcacggcttccgaaaaagctgatcgtccatccggctgaaccgagcggccgcggtacgcgggtatcacttgagttgatgtaagggaggagcggatatggcaaagcagactgccggaatatgtgagctgtgcggccggagcaatgtccagctgacagagcatcatctcacaccgaaagaggaaggcggaacgtttttgccgacagcgatgctctgtattccttgtcataaacagattcatgccttatataccaatcaagagctcgctgtacgtttaaatggaatggctgaactcagaagcgatccagagcttgcccggtttgtcaaatggatcagaaaacagccgcctgagaagctgatcaaaacaaagaaatcaaatgaacgaaaaaagaaaaaatgactaaaaagcagccctctctttgcagagcggctgcttttatccgtttccaaccatatcctgatcgttgacatcggggtctatataatttgtcgcgttgactgcgttatttaatagaaggaaatctcccgtgtttcctgctcccgaaccgagcgcagattttgaagagcttttcggagaaaggtaaaaggaatcaccaaagtttacgactccgcccgatatggaattgatagctataggcccgacaattgctggcataaacgacaccctttatcgaagtctctgtttattatatgttcttggcgggcgattgtgagcgcggagactgaatctgtctgatatgtttgattctcgcatcaccgcggataagcgaagctgatccggcatgtaaaacagaagagacggacaccccttgaattttgatgctgcgaacataaatagccggcacctcgtggcaaaatgcgctttgtacacctgtttcgggaatcggcttcactgcctgctgctgaaagatctggtactcctttttgttaaatgagccttcattattgtaaaacgtggacagagaacgctgaacagcaaatacttttacactcatatcgatttcatttgtgtcgccaacttgaaacacacttgcgatcccgagggaattaaacttaactagtctgatgcgtgatatgcgtttaagcattattctggcgcaatcggaacaaacggcccgataataagagattcaggcggtgtatcaaaaatagaagacaggtagatggattcagtgtctccgatgtggaaaacggaggaactggacacaccgttcatccggatgtccccgacttccaagctgcggttgatgactgtaaagatcatgcttgctcatctcctttcatttctgatggaatatgctccagaaagtgttctacagcgcggatgacatcacgcttcacatgctcagcgatatgttctgcatattgtgcaggcggtgtatgttcttcttttttgatatgggacatataatagtgaatccggctgtccatttgttttctgatgtcttcaataatatgatgtctgtttgtatcgtcaagtctgctgtcatattggttttcaagctgttccaaaatatctgggatttcttcggttaagtacatgtcgacattctggcggatctgctgcatgagctgagcgctctcttcctgctgcatcatcccgatttgcggtgtcgactggctgacttcaaagttttggacgctgttcgggtcagtcggatttaagccgatattcaaagtcccgtcgagcctttcaattttcagctgatcaaatttatactccacacgctcaatggtagtggccggccgctgtttcatcgtattcatttcagtttgaatctctttcagctgacgttcgagctgctgaatgtgaatcgcctgctgctgaacgaaggaattcaagttttgcaggtaagaggaaacagattgatcatacatgttctttcacctctttcatatgattaacggccaggaggctggagcgggaccaatgaacctgtgtcgggctcctgcagctggagcggttgccctgagccagaaacttctggtgccggttctacataactccctgtattatacaaatttgacagagacttgattgatccggcgctcccgatttgcagaatggaggagttgctgattgattccagccggagatagttgatttgaatggtttgattaatatagaagttcatgagcctcactccttttacgcattggccacgatcggctgatcaaccgcatcattgtcatacacattcgtcgcgttttgataattcatcaccttgaggctgtcgccggtattaaagctgccagcaccggcaaacgttctgacctgagcctgaggagaaatcgtaatgcagtccccgatgtgaacgactccgctcgtaccaatcgcattaattttaaacgctccgacaatggccggcatacgagcacatcctttgttgaaaaattaaaaaaagacaggtaaagtgaaatgacaattctgatttcaattgggctattcacgatagcttatgacaaacgcacatatgtgtgagagaaattttaaggggacatatcggctctttgtgaaagcgttttattttttcgggccgttatgtttaaacatggcaaaagaggatgttgggtataaattgagcggaaatgcggcgaaggatgccgctatccgcctatggtgatttttgtttatttctttggtgtttttgcgtgtagaatgctttttggagtatgtcgtgctgcggtattcgatttttgggcgggcacattctcgccctgaggtatatctcagaagtgctgagcaaaaatcggagttacatgtggtgtattctaattgttatagaaaatgatttacatacgggagttttcaagatatctcccaaaaatcatttcttctttaatccgggtattcagcaggatatccagctcttggctgcattgaatcgtttcttttgaattcatgccgtatttttgtgcggtttcaattagtgtgatcctcatttcttcaattttactgttcattacgctatctccaattctagattttattttgatataaatacaggatatcgttagtataacctattttggctcaaaaggttgcctttcgtcaatttgactaaaaaagcgacaatttttgctgcggccttttttaatggagaaaggactaaagtcttgctaagtgtgcttgcaaaaagtcctgccgttcctcaatttctctaagtatgttggtctgctccttttcgatttgaaaggggctttttttgataaaaggatcatcagcagcactttgacaaatgtcaaggtgccattcgttgatgagaggagataatcgttcaatagtaaacgaccgcttcagcacgtttttcattaaggtgtgatattgcgacctgaaggcgggaatggatagaagccttgacgaaagcgtctttccttttgtcagaagcgggtcttcgtcataccattcttgtacggcaagcgatcttgtctccatcggggaaacgtaaagccgaccggattcgtttaaacaaaatgtgtagtaaaagccttgattggtgcaggcgttgccgatcagccacaaaaaaaacagcttgacatccagatacaatttaatcctttcagccaattcgtcatctccggctgtgcggatcagtatgaaaaattcatgtaagaatgccgaggaatcattgttaaaaagggacaatggaacccttggatcggccgtcttcactccgtaactccttttaccggctggctgatggttcttgatgttcaaataaatgccttcaggctggccattgatggtcagaaagctgtacgaggcaacgggagcaggtacgccgatctggtcaaaaaaacaataggcgagtctacgccgcatcagggacggatcatcctgttctgcattcaaaaaaagtgtcctttcaccaagcagagacttttcccagctgatttcataggatgccttttccgctctgtcacgctgtgtgagaagaatgggagaaacagatcgatctgttacgaaaagccccttggcagtacctttccttttcagctgctcccgatgaaaaaataaatgcacgcgctccatattctttcctccttctcaaaacgacatttgtatgatatgtagagcaagcccgtcctgaaacgaaatgaaaacggaattgagaaaaagggatttcagcattcgacagagaatacatgaaggagcattctgatttaaaagatgatggaggaataacatgaaatttgcgacaggggaactttacaaccgaatgtttgtcggcctgatcattgacgatgagaaaattatggatttgcagaaggctgaaaaaaaactgtttgaacttgagacgattccgggatcgctgattgaatgtatcgcagaaggggataaattcgttgcacatgcaaggcagctggccgagtgggcaaagaaaccgaatgatgagctgggatcatttatgtattcattatctgaggtgaagctccatgcacccattccgaagccatcaaaaaatatcatctgcatcggcaaaaactaccgggatcacgcgattgaaatggggagcgaggctgatattccggagcatccgatggtatttacaaaatcgccggtaacggttacggggcatggtgatatcgtaaagagccatgaagaggttacctcccagcttgattatgagggagaacttgctgtcgtgatcggaaaaagcgggactcgcatttcaaaagaagatgcatatgaccatgttttcggatatacgattgtgaatgatatcacggcgcgtgatctgcaaaaaaggcataagcagttttttatcggaaaaagcttggatacgacatgtccgatggggcccgtgcttgtacataaatcatctattcaggagccagagcgcctcaaggttgaaacaagagtcaacggcgagctgcgccaatccggttcggcaagcgatatgatcttttccattccggaattaattgaaaccctctcaaaggggatgacgcttgaagcgggcgacattattgccaccggtacgccgtctggtgtcggcaaggggtttacgcctccaaaattcttgcggtcaggtgacaaaattgatattacaattgacccgatcggaacgctgtcaaaccaaattggctgaataaaactcgagggcggacccggacccgcccgttttttctgataatcatctttgtggcagaggacaagttcatggtactataagtggggtaatttatctgatagggggaacatgtatgacacacctacatattacgacatgggtggtagcgctgattctgcttttcgtcagctactcgctgtattcgtcaggaagtgcgaagggcgcaaaaatcactcatatgattctgcggttattctatatccttattattttgacaggagctgagctgtttgtccgtttcgccaactggaacggagaatacgccggcaaaatgattctgggcattatcaccatcggcctgatggaaatgctcctcatccgcaagaaaagagaaaaatcaacaggaggcctgtgggtcggcttcgtcattgtccttttgctgacagtgctgctcggtctgcatttgccaattggttttcaattgttttaatagaaaaacctatgaacccggctctttgatagagttgggtttttttatatttatcccctcatattccaaatcatttaaaataaccttaaaattccctgtaagcggtatctcgtcctatgaaattatgataccttcaaggagattcattattttgcaggagggataacatgaaacgcagaaaattcagctcggttgtggcggcagtgcttatttttgcactgattttcagccttttttctccgggaaccaaagctgcagcggccggcgcgatcgatcaggcggctgctctggaaaacggcaaagagcagacaggcgccatgaaggagccggaacaggtgaaatggtacaaagtgaccccgggagcaacggatattcagaaaaactcacatatggcactgaccgtaaagagtgattcagtactgaatgtatctgtatatccaagtaaggaaaaagcgcttaaagatgagacgtttgagatgtaccgttctttcacagcggaggatggaaaaagcgaagtcatctttccatacgcgtggagcggcccttactatgtaaaagttgaatacctcggagaagaagagccagaggacggcggaacggcagaagcagctgcagaagccaagtatacgattgggtataaaggcaccaaaaaacagccgtcagatttagaagaggaagaagcttgtccggttgaaatgagtgtcgatcagaagaaatcaggaaaaggcatcctggataagctgagagcgattcgtgatgagcagctgagccaaacagcagaaggcaaagaactgacaagcctttattacaaagcagcaccgtttatcgttgcaaaactcgcactcaataaaacagcaagaaatgaaatctatcaggatcttgtgacattaaagccgttatttgacgatgtgtcagaaaacggagcatcatcttcgtataaggtcactgaaaaggatcaaaaagcaatcaaccggctatatgataaagctttacaatcagtcccgtcattccttaaagaggagataaagaaacaaacggaacgactaaatatgaagcagctgcaaggcaaaacagccggagccattttaacagaaaacaatattgcagcaaaaagtgaagttcagacaacaaaggttattttcaaggtgaaggacaataaaagcctctcatccgtacataatgaaatgaagggcttttcagcaagcgcgcaatcgaaaaaagacatatccaatgtgaaaaaggcaaagaaactgtttgacaatctgtattcatttgaacttccgaaagacgagaaacagaacggcgcatatacggcaagcgccaaaagggtcaaaagcgctgctgcgacactatccaagatgtccaatgtagagtttgcggaacccgtgcaggaatacaaaagcctggcaaacgatattcagtacccttatcaatggccgcttaaaaacaacggtgaaaacggcggtgtcaaaaatgcggatgtgaaatatgagcctgccaacacattgctgtccaaacgcaagcttaacgatacactcattgcagtagtagacacaggcgtagacagcacgcttgctgatttaaaaggaaaagtaagaacagatctcggacacaattttgtcggacggaataataatgcaatggatgatcaggggcatgggacgcatgtcgcaggcattattgcggcccaaagcgataacggctattcaatgactggattgaatgccaaagcaaaaatcatccctgtaaaagtgcttgattccgcaggttccggagatactgaacaaattgctctcggcatcaaatatgctgctgacaaaggagcaaaggtgattaatttaagtttaggcggaggctacagccgcgtgcttgaatttgctttgaagtacgcagctgacaaaaatgtcttgattgccgcagccagcgggaatgatggagaaaatgccttatcttatcctgcgtcttctaaatatgtgatgtcagtcggcgcaacgaaccgcatggatatgaccgctgatttctctaactatggaaaaggtctggacatctctgctccagggtctgatatcccgagcttagtgccgaacggaaatgtcacgtacatgagcggaacgtctatggcgacgccgtatgctgccgctgctgcaggattgctgtttgctcaaaatcctaagctgaaaagaacagaagttgaggatatgttgaaaaagacggcagatgatatttcctttgaaagtgtcgatggcggagaagaagagttgtatgacgattatggcgatccgattgaaattccgaagacacctggtgtagactggcattcaggctacgggcggctgaacgtcatgaaggctgtcagcgcagctgatttacagcttaaggtcaacaagctggaaagcactcaaacagctgtcagaggaaacgcgaaggaaggcacacttatcgaggtgatgaacggcaaaaagaaactcggcagcgccaaagccggaaaagacaatgcgttcaaggttaatatcgcgcctcaaaaacaggatcaagtactgtatgtgaaagcaacaaaaggcgatgcgaaaacatcgtataaagttgtcgtcgtcaaaggaaaaccttccggcacaccgaaagtaaacgcggtgaaaacgaaggatacggcagtaaaagggaaggcaaacagcaaagcgatgatcagagtgaaaaacaaatcaaagaaagtcattgcttctgccaaagctgacgcaaaaggaacgttttcggtgaaaatcaaaaaacaaaaagccggaacggtgctgtacgtcacggctgcggatacagataaaaaagaaagcaaggaagcaaaagttgttgttgaaaagtaaccaaaaagcggtgctcgatgcaccgcttttttatttgcgcccccgttggactgctgaatacataatggatcgctttccgtttgaagccgtccattcaaaacggtctcctgtcccttcgttgctgtagtgatgctgcatcgcgcattgtgcggtgtcatttgaaaagtgataaaaggacacaccctgccccgccgaagtattcgaaaagactcctttattataagaaaagacgcaatcgaataccgataagccgaagctgtgcaagtgctgcagaaatgcgagaaaggtttcgtcgtcaagcgaatccaaaagcgccatgagcggccgcttgactgatttctcatagcggatgcgttctcccccggaaagggagatgttttcttcaccgcatgccagaaccaattgatcctggaagccggcttgctcccactttcctttatgatggacccagattgggctgtgttggagagtgtccgccaaaagtatatcaccttctccgttttcgattaaacagacgccgtcttcgatgcggatggtgccgtattcccattttcgttcctctgtatataacaattgtttccgtttcatccatgctgtctcctttttcttcattcctctcttttctttccaattcaagcctgtcccatacaactcttttatggacaaatcaactatctgcctatagatgcataaacttactaaggtgctgaaagaaacgaaattgttacgaaagaaacgggattggagctgatgtcacatgtgtggaattacgggttgggtcgattttaaaaagcagctcgtccaggaaaaacaaacgatggacagaatgacagacactctttccaaacgagggcctgatgattcaaacgtttggggggagcaccatgttttattcggacataaaagacttgcggttgttgatattgaaggaggacgccagccgatggcgtgtacctataaaggggatacgtacaccattatttacaatggcgagctgtataacacggaagatttgcgcaaagaattgcgggcgcggggccatcaattcgagcgtacgtcagataccgaggtgcttctgcacagctacatcgagtggcaggaagactgtgtcgaccatctcaatggcatattcgctttcgctgtgtgggatgaaaagcgtaatctgctgtttgccgcgagagaccgtctcggtgtaaagccatttttttacacgaaggaaggctcttcatttctcttcgggtcggaaatcaaagcaatcctcgcgcaccctgatataaaagcgcgagtggacagaacgggactttctgaaattttcggtcttggaccgtccagaaccccgggcactggcatatttaaaggtataaaagaaatccgcccggctcatgcgctgacattttccaaagacggacttaatatttggcgttattggaatgttgaaagcgaaaaacatacggacagttttgatgacacggttgccaatgtcagatcgttatttcaggacgcggtgacgcggcagcttgtgtcggatgtgcctgtttgcacattcctatcaggcggtctggactcaagcgcgattacagcgattgcggcgggccattttgaaaaggaaggaaaagcaccgcttcatacttattcgattgattacgaagagaacgataaattttttcaagcaagcgcttttcagccgaatgatgacggaccatggattgaaaaaatgacagaggctttcggcacaacgcaccacaaatgcgtcatcagccaaaaagatctcgttgatcatttggaggaagctgtactggtcaaagacttgccgggaatggcggatgtcgactcatccctgctgtggttttgccgggaaatcaaaaaggactttgtcgtcagcctatcgggagagtgcgcggatgagattttcggcgggtacccgtggttccatacggcagatgttgagtctggctttccatggatgagatcaacggaggagcggatcaagctgctttctgactcatggcagaaaaaattgaatctgaaagaatacgtaaatgccaaatatgaagaaaccttggcagaaacgccattattagatggtgaaacgggtgtggataaagcaagaagacagctgttctatttaaatatgctttggtttatgacgaaccttttggatcggaaggatcgcatgagcatgggggcgagcctggaagtgcgggtgccgttcgccgatcaccggcttgtggaatatgtttggaatattccgtgggaaatgaaaatgcatgataatcgggaaaaaggcattttacgcaaagcgcttgaaggtattttgcctgatgacattctgtatcgcaaaaaaagcccgtatccgaaaacacatcatccggaatatacaaaaggcgtcagcgaatggctgaaaacgatcagaagccaaaaggactccgtgctccataccttgctggacagaaaacaattagatcagcttttagaaacggaaggctcctccttcaaggtgccgtggttcggacagctcatgaagggacctcagctgatcgcccatcttgctcaaattcatacatggtttgaagcgtatcgcattgatattgatgaaggatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatcggctttttcttcatatacaattgcgagaaaacataatagacttgaagaagcagtgatacataggagtgaacagaaatgaaagagataaaagaagcctatcagcaatgcggccagatcgtcagcgcccgcgaaccagcctgttacaaagcattttcgtttcttccgctgaagcaaaggcaggcagcttgggcggttatggcgttttgccatacggcagccaatgcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcgtaccaaacctttacactggacagcaagccattccgtgagttcattgccgcacagaaagcggaagataaaccgtttggaaaccttgatgaattgctcatgcacgcataccagacaggcggcgcagccggattgatgctgctcccgattatggcgcgccggcatcagaaacagctgacacatgcagccggttctctcggtttagcgattcagctgattcgnnnnnnnnnnnnnnnnnnnnnnnnncagcaaaaaagccgtatccctcgggaagtgatgcagcaatttggatatacagaggacgaccttcaaaagggcgtcgtgaataaggcgttcacaatgacgtgggagtatatcgcttttgaagcagaagcctaccttgaagagtgtcaggatgccttgccgctatttccgcagtattctcaaaaaacggtgaaagccgctcttcatttgcaccgggctgttttagaaaaaatccgggcgaagcagcacgatgtatttcaacatcacttcgctctcacagagagaagtgaagcagattctctctgatatctaaaaaaacacccggtcttgattgagccgggtgttatgccatacctttttgaatccaaatacgtgagcgccatcttctgtacattaagattccccggacccattcatccgcgataaaagaaatccaaatgccggcaagaccgaaaccgagatggatgccgaaaagataagcaagcgggaggccgatgccccacattgaaatcattgccatgtaaaccgggaatttcgcatcccccgcggcccgcagagagttaatgataatgacattaaacgagcggcctggttcaagaataatggtcatggcaatcaataggcttgcagttgctataatgtcagggctttgtgtgaagagtccgatcaggtcttttgaaaagatcgtcatcaaaacagaggtagccgcagcaattccgagtgcccaatataagctcttcatgcagcgctcataagcggcatcaaattgtttgccgccgatataacggccgattaagatttgtgtaccctggctgatcgcagtgccgaacagcaaaataaacatcgtaatattttgcgtatacacttttgttgtcaacgcctgcgcgcccatgatggcgataaaatacgtgacaatcatttgcgaaaggttgtatgaaagctgctctcccgcagaaggaatgccgattttcagcagcttgcgcaaatgctctttatgcatatgaaagacttttttcagcgacatcttcagctggatgcgtttgttgacaatcacaatcatcgcgattaatccgatgacgcgggcgatagatgtggacatggccacaccggcaacaccgagaacaggaaagccgaacaaaccgaaaatcacaacaaagtttccggcaatgtttaaaatgttcatgccgatagtgacaaacattgtatcttttgtgtagccgtagctttttaagatcgcgctgaatgtcatgattaaagcctgaataaaggacagacctccgacaacttgtaaaaagactttcgcatcaggcatcagtgcgtctgataatcccatcatatgaagcagagggacagccgcgaaaaagacgacggcgctgatggccaggctgatgaagaagttggcgccgattgacacataagcgacttccatggcttctttcttttgccgtgagcctagaaattgtgaaatgataacggtcgttcctgttgcgataaagctgaacatcacgataattaaatttaaaatctggttgctgacgccgactgctgccacgctgttatccgagtattggctgagcatcagtgtatcggcattacccataaacatatataatgagacctcaataaagatcggccaagtaagcgaaaataatgagaacgttttgtcagcgggttttttcaaagcagttgatttgaagacagcttgtttcatagtgtctaacccctttcgtaaataaaatcaacgttttaaagtgtacctccatttccttataataaaaagggatagaaacgatacttcttgtaaaaatccgacttaaaaaggaggatgattcaaatgcctcgcatcctgtttacagtcccgccttttccggtatttatcgcagctggggaaggggtttttaaaaaaggagaaacccatgtgaaacgtgtattctccgtgtttgatctgatatatgtcaaacagggaacgttatatataacggaaaatgaaacatcgttttctgttgaaggcggcgagtacatcttgctttctcccggtcttgaacactacgggacgaagggcagtgatgaagcaacctcctactattggcttcacttcgatgaacatcgatatgaatttacggcaaagggaggcagcaactggtctgagcttcagcaggaaaaagggagcttcgaagagccggcccgctacggattggctttgccgagaaaaggcaaggtgcagcgcccgcagtttatggcgcagcagtttgaaaagctgatcgattactccgcggaaaactctgatttgccgctcagaaagcaaattttatttgaggagctgatgctgcatcttcaaaaagaagcgttccaaataccgtctgcgaaagagcgggtagcctgggaggcggcccggtacttacaggagcactataaggaaaagacgacaatcaaggatctgtcgctcgcccttcactatcatcaggattatgtgagccgctgcatgcagcaggtgctcggcgtaactccggcacaatacacgaaccgggtgagaatgacggaagcgaagcgtcttttatcctctacaaatgataaaatgggcgttattgcggaaacggtcggaatggaagatccgacatacttttcaaaactctttaagcagatagaaggcatttcaccaattgaataccggaaaattgtcagccggaaagttcaataaccagacgagggatgaacatgaaaacaacaatttatgatgtggcaaaggcggcgggtgtctcgatcacaactgtgtcccgtgtgataaacaatacggggagaatcagcgataaaacacggcagaaggtcatgaatgtcatgaatgaaatggcatacacgcccaatgtccacgccgcggcgttaacgggaaaacgaacgaatatgattgctctcgtggcgcctgatatttcaaatccgttttacggcgaactggccaaaagcattgaggaaagagcggatgagctcggttttcaaatgttgatttgcagcaccgattacgatccaaaaaaagaaacaaagtatttttctgtgctgaaacagaaaaaggtggatggcattatttttgcaacagggattgaaagccatgacagtatgtctgctttggaggaaatcgccagtgaacaaattccgattgccatgatttctcaggataagccgcttcttccgatggatattgttgtgatagatgacgttcgtggcggatatgaggctgccaagcatcttctgtcactcggccacacgaacatcgcctgcattatcggagacgggtcaacgacaggcgaaaaaaatagaatcaaaggcttccgtcaggcgatgaaggaagcgggcgtgcccattgatgaatcacttatcatccagacgcggttttccttggaaagcggcaaggaagaagcgggaaaattgctcgacagaaacgctccgactgctatttttgccttcaacgacgtattggcttgtgccgccatacaagctgcgagaataagaagcataaaagtgccggatgatctttctatcattggttttgataatacgatactcgcagaaatggcggctccgcccctgacaaccatagcccagccgataaaagagatggggcggagcgtcatcgaactgctggcagaagcaatagagggaaaacgaaaggcgaaacaaaaaatagtgctcccgcctgagcttgtagtcagacattctacatcaccgctcaacacatgagcccgctaatgagcgggttttttcattatgacagttgaagcaaaaaaaaacatattgcgtgtaaaccaatggcagtgtaaaatgaaaccatcttttgagaaagcgcttgcgcaaaatggcagagcggatagaaccgctgtttttttagttgttaagagaaagcgctttctcaaagcgagcctgaaatgagataaaggagaggatgggacgtggaacatcaagtaagatgtgcagtattgggattaggaaggctgggttattatcatgcgaaaaatctcgtcaccagtgtgccgggggcaaagctggttagtgtcagtgacctgttaaaagggagagcggagcaggttgccagagaactcggtatcgaaaaatggtcagaggacccgtatgaagtgttagaagatcccggcattgacgctgtcattatcgtaacgccgacaagcacacatggtgatatgatcatcaaagcagccgagaacggcaaacagatcttcgttgaaaaaccgctgacattaagccttgaggaatcaagagcagtttctgaaaaagtgaaggagacaggtgtcatttgccaagtcggctttatgagacgattcgatcccgcatacgcagatgccaagcggcggattgacgcgggtgaaatcggcaaacctatctattataaaggctttacgcgcgaccaaggcgcgcctcccgcagaatttatcaaacacagcggtggaatttttattgactgttccatccatgactatgatattgcccgttatttgctaggggcggaaatcacttctgtttcaggacacggcaggattctgaacaatccgtttatggagcagtatggcgatgtggatcaggcgctgacgtatattgaatttgactccggcgcagcgggggacgtcgaggcaagcagaacctctccatacggacatgacatccgggcggaggtgatcgggacagagggcagtattttcattgggacattgagacatcaacatgtgaccatcctttcggctaaagggagcagttatgatatcattccagactttcaaactcgttttcatgaagcctactgcttggagcttcagcattttgccgagtgtgtccgggatcgaaaaacaccgattgtgacagatattgatgcgacgatcaatttagaagtgggtatcgccgcaaccaattcctttcgaagcggcaggccggtacagctagatgtgaagcgcgcttatacaggtatgtaaaagctaatatgttgcattttaggctttccgcaaaaaaaagcaaggacatttttagcccttgctttctcttttctcatataaatagtacatataatcagtaggtgcgccagaatggcccagctgtctcagcatggcggttacgtttcctctgtggtaagtgccgtgattgacgacatgcaggatggtgtctgcataggttgattccagtgtacctagtttcggatgctgcattgtgaaggtctgttctaagtccgtctggcggctgaagaaatcatgatactgtgactccagctcggcagcgtgctgtttaatcgctgccatattaccttgcgcggactctaatttgcctgcgctgtctataatctcttggtaggccactcccgaaagaacattcagccaaatgtagtcagccctgcacatatgaagcagcacgtcgctgacagaaggaaatacgctctttacttcttgataggcagtttcctccggcaggttttcgatatgggtaaatattttcttgtttgcccaagaatgatagtcataaaactgttttgcatcagtcataagcatgcccccttttctaagaaattcgtttttttcatctgtttctccttcaattgcaaaagagtgacaccccaaaatatcctgccgctgcccacattaccgctgcagagcatttgtttacgatcagcataagcctgccgctcgtatctatcgtctgaaacaaccggcccgctattgcaaggctgataaaccaaatccaagacacagcgatgcaggcggccataaagagccatttctcaagccccgaatattgaagagagctcgtgccgatgacgccgatcgtgtccagaatggcatgcgggtttaaaagagaaacagcggccgcaaatgcaacttgcttttttggtgtgaacgtatgtttctcgttttggcttgtgttcggacggctgttccaagtcacccagcccatatagagcaaaaataaaaatccgccggccatcatgactgtctcaaacacaggcagctcctgcacaatgacagacacgcccgcaacggctaatacgattaacagggtatcgcagactgaagcactgatgacagctgggagagcccgccaaatatgcttttgccacgcgccttgctgaaaaataaacacattctgcactcccagcggcaaaattaagccaaacgcgagcacaattccgtgaatgattgcattcatgctgaaaaagctcccttcacatttttttcaatcataagagagattgtcactaaagtctccagccatttggttgggttaggaaccagccaaatgtataatgtgtaaaaaagggggggcatgaccttgtcgcaatggcagccaagccgaaagtcggatgttccgctgcatcggcagatcgaacaatatatgaaagacaagattcttcacggagagtgggctgtagggacgaaaatcccctcacagagaacgctggccgacatgtttcaagtcaaccgcagcacagtcacagcagccatagatgaactcacgtctcaaggcttgttagagggaagaagaggcggcggtacgaaggttgtaaacagtacttggagcgtgctggcggctgagcctccgcttgattggagcgattacgtccgttcgggcattcatcgcgccaattcttccatcattcaagctattaatcagaacgaaccaagagcggatatcatcagattaggaactggagaactttcaccggatcttgtgcctgctgacacaattggacggatgtttcagcaaatcaatccgggcgtcctgtctttaggatatgagcagccgaaaggaaaccgtcagctgcgggaggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagctgggatgcggcttcgcggcttgccgatggatgatgaaggggtcaaagcggggcttgtttcttctaatcgaaaacaatatggaggacagctgctttacacgattccgtcgtttcataatccgacaggcacagtcatgtcagagcagcgaaggaaagagatcatcagcctgtcaaaaatagagcagctgcccatcattgaggatgatgcgtacggtgatttatggtttgaagaaaaaccgccgcagccgttgaaagcaatggatcatgagggcaatattctgtatctgggcacgttttcaaaaacggttagccccggcctgcgaatcggctggcttgccggtccggagccggttattgaaaggttggcggacattaaaatgcagacagactacggatcaagcggcctgtcccagtgggcggctgccgagtggctgtcacaggggtattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgttagccgtttcttttatggattgctgaaacggcaggtgcttgtgaatcccggctatatttatgacggtgaagaccgaaacagcatcaggctgtcatattcctatgcatctcttggagatttggaaactggcattaaagcggcagctgaaacagcacgccgcctgatgatgtcctaggctttggttatacgatgacagctcccagtgccctggcgaaggcaatcgcatgctcaggtgcgattttgcagcctttcaatttgtcgagggagacatgaagctgttcaaaacggcacgtgctgatgtccatgttttgaagggatgtgccggtaaagctggcgccttccaattcgcatccgtcaaagtgtgtctgctggagcaccgtattgctgcattcactttgcataagagcacagtgatcaaatcgaacttgtttcatatttgagtacgaaaatgagctgaaatgtccgtggcattcctcgaatgaaacattccgcagcgttgcttccgccacattcattccaaccatttttgactgcttaactgaagttctgtgaatgacagccccgctgaaatcggcgtttgataaatcacatttttcaaagatcacatcggtcagttcaatatgccgaaaagacacatcgataaagacgacatttctgaataccgttttttccacacagagtctttcgatatcttcgccgcagattgtacaatcttcaaacaaatgcatgctgattacatcatcctgcgtcacggcatcatgaaaatctgcggtttgcaggttttccggtatgttcggtttttgaattgcgattttattcatgtgatgacatcctttgctgcccgaaaaacagaggcttccgggttcaatttaatagatcgttaaggaaattgatacatatagtaaatcgtgaagagccttttcttggtacagcagccagcttgttttgtaagcataaatggaaagcttcctatacgtcaaggcgtttacaggccgggaaagccaaagggaacaggaggaatgcggaatggggcattacatcaaaaccgaggagcatgtgacactgtttgtagaggatatcggacatggaaggccgatcatctttttgcacgggtggccgttgaatcataagatgtttgaatatcaaatgaatgagcttccgaaaaggggatttcgttttatcggcgttgatttacggggatatgggcaatctgaccgcccttgggaaggctacgattatgacacgatggccgatgatgtgaaagcagtcatttatacgctgcagcttgagaatgcgattcttgccggtttttcaatgggcggcgccattgcaatccgttatatggcaaggcatgaaggagccgatgttgataagctgattttactgtctgcagcggcccccgcgtttacaaaacgcccgggttatccgtacgggatgaggaagcaggatattgacgatatgattgaattgttcaaagctgatcggcccaaaacactggctgatttagggaaacagttttttgagaaaaaagtgtctccagagcttagacagtggtttctcaatctgatgctggaggcctcctcctacgggacgatccactcgggcatcgcattaagagacgaagatctcagaaaggaacttgctgcaatcaaggtgccgacgctgatcctgcacgggagaaaggatagaattgcgccgtttgattttgcgaaagaattgaagcgcggcatcaaacagtcggaattggttccgtttgcaaacagcgggcacggagcattttatgaggaaaaagagaagattaacagtttgattgcgcagttctccaactcataagaaaaaacccgacattgatcgggttttttatataattcctctgttttgcagtgcgttaatgatgagatcagctccatcggaaatagaagtctggtcagactcaatgatgaaatcgggtgaaagcggcgcttcatacggagaatcgatcccggtgaaatgtttgatctctccgtttcgcgcttttttataaagcccttttggatcgcgctgttcacaaacatgcagcgggcacttcacataaatttcgaagaactcacctttaggaaagagcgctctaaccatgtcccgatcctctctgaatggagaaataaaagccgttaaaatcatttgcccgctgtcgacaaacagcttcgccacttctccgatccggcggatgttttcaatcctgtcaccagtctgaaatccaagatctttgtttaagccgtggcggatattatcaccgtcaagcacgtagctctgaatgcccttgcggtaaagcttttcatcgactgcattggccagcaccgattttccagagccggacaaacctgtaaaccagaggacgcagcttttgtgtccgtttaaggactgtctgtcagactttgagatggcagcgggatgccaaatgatgttcggattgtgtgtcattgcaattccccgctgttttgcttgatggcaacaggctgttggtgaagtcccttgatcagcacggctgcgacctcaggccggctgaattctttaggcggctttttgccttggcggagaagctctctcacttttgtgcctgataagtggatgtggtctctcgggctgtgcggacatgttttggaggtgcccatgtttccgcattttcggcaataaaagctgtgctcaaaaaacagcggcttgatgcccagctcttcctctgtgaatgattgaaaaatattttgggcgtcgtatgttccatagtagctgccgacacccgcgtgatcacggcctacaataaaatgggtgcagccgtaattttttcggacgagcgcatggaaaatcgcttcccgcggacctgcataacgcatggcggcagggaaaaccgataacatgacacgatcctttggataatagtgattaagcaaagcctggtagctctccattctgatatcgctggggatatcgtctgactttgtttctccgacaagtgggtgaagcagcagaccgtcgaccgtttctaacgctgttttttgaatgtattcatgcgctctgtgaacagggttcctggtttgaaagccgacaatcgttttccagccgagtttttgaaaggccgctcttgtttctgcgggcgttgcataaaactgtttgaaagatttgtcaggcaggcggctgaccgtgataggccctccgatatagtaatccgggcgcgccagcaatttttttacgcctgggtgggcaggatcgtttgttttaaaaacagacagtgcttcttgtgttttatcaggctggtatatatcggtgactgtgatcatgccgtaggtaacaccgtctttcacaagcttgacgtgatctccggcagacagctgtcttgctgttttttctccgacaggcagcgtaatcggcaggctccacggcaagccgtttgccagcctcatctctttcacaacggaatgataatctttttctcccaaaaaacctgttaacgggctgtagccgccgatcgcaataagctccagatcactcagtgcaagctgatccagctctgcttggcacgcgcacccttcaaaatggcatgcgggatcacagcggttgattaatacccctccgtggggttcgtttccattcaacgtgttcaacctccatttatacgtttccttgttttcttttctgcacttaatgaaagtttgacatcagcgccttaacatcatttcgattctcacatcaagaacctgccatccgctattcttgatgcaggccgcattctgttttctcccgtccggcccatcttccagccctctcatcgttcgggtccggggaaggcagtgtacacatttcacagcctatgctcggataatgttgatcgtgcagtttgttataaggcaaattgtgcaggcggatgtacgtccaaacgtcatcccatgtccagtggataagcgggcaaattttgatgagctcaaacttctggtccaggtttacgtattgaatatgctttctcgttggtgactgctcccggcgcagtcctgaaatccaagctgtcatgccggacaggtgctttttgagcggttcgattttccgcaattggcagcagaggttcgggttatgcttccacagctctccgccgtacttcgtcccctgttctgttaagctcagctcgggttcgagcatctggattgcaaatcccggatatcgctctttgacggtctcgatcagctcatatgtttcctgaaaatgaagcccggtatccaaaaagatgatgtgtgcgtttttgttgatttttgatattaagtcgagaagcaccattccttctgcgccaaagctgcaggcgtacacaatcttttctccgtacgttcggtaagcccatttcaacacatcgagctcatcgatcaattgatccgttatccgtttggacagcatgtcgttccaagtgtcatatgtgatggtttcgttcaatgttttccccccgtttgcatctgctttttttatctattgatcgagttataggcagactattcattttttgcataaaggttcaggttttaggtgccgcgcccgcctaaaatgaggtgcggaaccattaagagcccggctgaatatgctttttagcaaaatggttttatgcccaaggagaggtagtatgccgattgccatttatcaggggcatcatcattcgcttgccccggcggacattaacatcgtcattgatgtcatcagagcctttacggtcgcccattatgcgtttatcggcggggcgaaagagattttgttggtccggacagctgatgaagcctttgcgctgaaagacacctatccggattatgttttgacgggagaggaaaagggggtcggtatcagcggatttgatttagataattctccaaaacgtatggctgggcagaatatgacggataaaagcctgatccagaaaacaacaaacggcgtcacagcagcattgggggcgctgaacgcaaagcatctgttcgtaactggattttccaatgccaaaacaacggcacagcatgtgaaaaagctcgtcgcaaacgattgtgtcataaacatagtggcttcccatccatccggtgatgacgatatggcgtgtgcggagtatatcaaaggcatcattgaagggacaaatgcggtaacggctgaggaggcgattcaaagaataaaaggctcttctgttgcagagaaattttttgaccgccgccagccattatttgattcggaggacatcgcttactgtgcaaaagaactgacgggcgattttgtgatgaaagtgaaacaagatggagaagttccaacgatagagagggtcataatatgaatgatttttcactagaattgccagtgagaacaaataagccgagagaaaccgggcagtccattttaattgataacggctatcccttgcaatttttcaaagatgtcatagccggagcgtccgactatattgattttgtgaaattcggctggggcacatcattacttacgaaagatcttgaagaaaaaatcagcacactgaaagaacatgacattacatttttctttggcggcacactgtttgaaaagtacgtaagccagaaaaaagtgaatgaatttcatcggtactgcacctatttcggctgtgaatatattgagatttcaaacggtacgctcccgatgacaaataaagagaaagcggcttacattgccgatttttctgatgaatttcttgtgctcagtgaggtgggcagcaaggatgcggaattagcaagccggcaaagctctgaggaatggcttgaatatatcgttgaggatatggaagcgggcgcggaaaaagtgattacagaagccagagaaagcggaacgggagggatctgttccagcagcggcgatgtcaggtttcaaattgttgacgacatcatttcctcggatattgatatcaacaggctgatttttgaagcgcctaacaaaacgcttcagcaagggtttattcaaaaaatcgggccgaatgtgaatctggccaatattccatttcatgatgccatcgcgttggaaacgctgcgtttagggctaagatccgataccttttttctgtaaaacagcggctgcggggctctcgtcgtgaagagagcctctgcctattattttttatggcggtacataggcgtgagatagggaagagaggtcaggcggatgttgtagatgaagtcgatgactcttgtcgatatcacctggcatatgagggcttgaatgacgatgccccagtcaataatagacgcggtgaccataaaaatgatgcaattcatgatgagcaggatcgttccgggattcccgccgcggtagatagaaatcatcagagcaagggctccgaatcctccgttcgaaattttatatttgtataaaagtccgatgccgagtcccaataacactgcgccgcttgccagatcaagccacagattagatgtgatatccggaaaaaccgcatcaaagatcaataccgagacagaggtgacggtgatagaagcgagggtgccggtgaatgttctcatctccagccattttaaagcggtaaaaagcattgatacattcacagcccacactgaaaatccgtgggggatttgaaacagataatgcaatagcaccgcaatacctgctgcaccgcctgtcggaatatcatgcggaaataaaaacaaggacatgccgagtccctgtagtacgccgcctacgacaatcataaacgtaagttttgctttcatcagcagttcagccattaagtcatttgctcctttatgaaaagacttgtccgctgttttcattttatgaggctgtccattatttatgtctcaaaataaagaaatggcccagcttaatatgctgagccatcccacttgtagcgattgacgacctccatattgatctctgttccaatgccttttcctttcgggatgtggaccattccttttgaaggctgcaggctgacgagatctgtaaaaggattctccatgacgtcccactcgatcggttcaatgtgatcgtacttcattttagaccatgggggcagacaggcttgtgcaaataaagcatagagccgtgagagcgatccgtcatatgcatgggcggatgctctgacgccgaaataacgcgcgagctggaggcagtcccgaaactcatcaattccgttgacatgcatgacatcgggctgaatgatatccaaacagcgctgtgaaaggagaggcacatattgcgccgggcctttcatgttttctccgccggcaacaggaacagacaaacggcttcgaagcatagcgtaatcctgcggctgatcaaagggcaaaggctcctcaagccagccaatgttcgtccattcggagaaatagcgctcccatttaaaagccgcagcggcatcgtagctttggtttgcgtccagaatcatcgtaatggagctgcctgctgtatgctgcagcgcattgatgtgccggacatcctccttgaatgaagtcccgccaattttgactttgatttgctcaaaaccttttttcaactgggcttcaacattggagactgagcggctgatccattgcggggagtctgagtacgattgaaaagacgcgtacacaggaatctcctctctgtatcgcccgccccataattcgcaaaccgaacaatccgcagctttggctgcaatctctgtcagcgccatgcttacagcggaggccgcccgctggtgccatttttgaatcgtgcgcactaatgacaggcggctgccagcctgttttcctaatagaaatgggatgatccgcttcgtaaaaccgacatggagagcagggagccaatcaacgcattctccccagccgtctatcccgctttcggtgataatcctgatgagataacaagtccgatatcgtttaaacccattggcatctccgtatggcttttctaatcggtgaaatagcggaaaggtttcaatccgtacaattttcacactgggtgctacctttcctcagcgggctggagccgattgccagccattttagggtcttctttttcttttgtttcttcattgttttgcttcacatggatgagcatcatcacaagaatcccgacaacgagagtcaatcccgcgatgcttaaaaacatgccgggtctggaccattgcatcaggcggccgaaaatcggaggaccgatcgctacccctaagaaacgtacagagccgtacagcgaggtgacaaatccccgtctttctttgccgacagccccggtaatgaaactgttcacacaaggaaggacaagacctgagcctatgctgctcagtacaagaacactgataaaaaggacaagattttcaatgaatgacagtgccgcgtaggatacggtcatgaacgccaatccaagtacgatcagctttttcattaacgattgcttttgcccgattttgcttcctgttgtataggacgtcacacacataaccaaaagcgggatcgctaaaatcaagccttttttcacgccgtcggtgtcgtatgttttttcaagaacatctgagagataaaacaggatgccgaataaagtaaacaaacaggtcgcaccggctaaataagcggtaaacagccatctgccctcatgtttaaagacacttaacagcccttttgcatattttccgattggtggcggttctttttcctttttcttttctttaataaaaatccaagtcagtacgatcgaaatgatacaaaacacaggaaaggcaaaaaacgcaccataccagacaagcagggcgatcagcgagccaatgatcggcgatagcactttccccattccgtttgaagcttcaacaaggccgagcaccttgctctcctgggcgcctttaaacagatctcccgtcagtgccatggcaattgggccggttccggctgccccgattccctgtaacgctcgtcctgccatgacccaagggtatgcattgtcaaaaaaacctgccgcaaacccggctaacaaaccgccggcaccatacaaaattaagcagggaataatgatgactttccttgagaatcggtctgcgagataaccgacaatcggaatcgcaaatgctgcaatcaaggaaaatactgtgatcacgagactgacttgaaattgtgataaatgaagttcagatttcatttttggcaaaatcggaataagcatcgagtttcctagggttaatattaaagggattgaaccgattgctacaaccgtcattccgttattttgttttgatgattccatctcagagcacactccttttcttctgcttagaatgtccctgatggcttcgtttattcagcgatcagacagcaaaaaaacgaacagaagatacctgttcgggaaaaaagagggttaaccgagagcctgtgaaatcaaagcatataagtgtccattttgaataggcgcttttttctgataaaacaaaagcggaggttcatcatctttacgaaatcccatttctatcaggctgtcatgcagagacgtgtgttcactcggtatatcgattcgcatcggcccttgtttgccggccgccagcctgttaattatttgtgctgcaacatctgatgatgcagcgatgatagggccgaatttcaaattggccggtgtctgtacagaaagtccgtagccaattagctgtccgtcatgatttctggcgatgatacattcgcatgaagcagaaataagctgctgcaaaagatttgatcgatctccgccaaaggcttccagatccgccgcggttaagtcgtgaaagtcttgttctctaaaggatgtcagttcagcatcaagctttttagtataaggttgaaaactgtgacagctgtactttcgcactgaacctgccgtatgaaaacctgctttttcataaagcggcaaaccttcttttgtggcgcaaagcctgatggcggtgttttcacccgcttgggggatacaggcgtttaccatacgccggccgagaccaagccgttgatattctttgtccacgatcacgaggccgatagaagcaagccggccaaacaaaaacaagccgatgcaggaaataatatcaccgctgacattttgatagccgaaaaagcgtccttgctggacaagcagtgccagctcttgttcgccgtaatccggccacccggcttgcctgcaaagccgcaatagactagggatatgttcttcatgaagcttaatcagcttatcgattaccctcatacagattacctgcttgtttcgagttttttatacatgatgatatgagtgcctatgccgggaatctcaaaaggttcgccgagtacttcccacccaagctttgaatagtagcctttcacatggcttctggcattgcaccagactgcctgaacgccgttctttgccagtttctcttccgcgtgtttgatcagcgtgctcccgcctttttgatcgcgatatccttcaagcgttgccatgcctctcagccgatatgctggggattctgttattaatggctgattttgcggggaaaaagaagcgatgctgatcagcttcccttcaaaaaacgcgccgagatgaaaggagccttttgcatgatcctcttcatatttgcattgttcaatggattgatggggacgcagaatgcggtgccggatttcatatgtatcttccgcggaaatggttttgacttcgagcataatgttcctcctcatgactgtttttctatatcgtaacacgaatcccgttgaaaaagaccgcccgattggatcagacagtcttttaagggattaatgcaaaaagatattttggcgctgctcatctttttgctgaatatatgaagtgagctcggcggtcaagtcagatctgaggaaaggcgttatcaagtagatgccgttaaacagctcgcatgccgtatccagcagggagcgtgcaatcgcaaggccttccgctttttgcttttctttatcttcaccggcatgggccattttttcgcgaatcgtatcagacagcttaatgccgggaatttcattatggatgaattcggcattccggctgcttgtcagcggcatgatgccgatatagatcggcgtcttcagatgttttgtttcgttatggatatcgacaagctgctgctcggaatagacaggctgagaaacaaaataatctgcgccgcaatctatttttttctcaagccgttttaccgctttatccagatggcggacgttaggattaaatgcggcggcaactgagaaattcgttttcttgccgagcggttttccagatagagacagaccttcattgaattgtttgatcagcctgattaaatcaaaagatgttaaatcatatacagacgtcgcaccaggaaaatccccgattttagaagggtcacctgtaatcgcaagcacgtcattcagccctaacgtatcaaggcccattaaatgtgactgtaagccgataatgttacggtcacggcacgtaatatggacaagggaacgcatatcgagctgttgcttgatgagagcgccgcaggcaacattgctgatccgcggggtcgccagagaattgtctgcgagtgtcagggcatcgattcccgcttcttttaattcagcagccgccgatagaaatttgtcaaagctcagttttttcggcgggtccagttctacgataatagagcgttttttcgctgcgatctcatccaggccgggctcggttcgctcgtgatgaacagaaatgaattctttcgcccgggttttgacttctttttctgtaatcggaaccagcccgccaaccgcttccgccatcgccctgatgtgattcggcgttgtcccgcagcagccgccgataatccgcgcgccttgcttacggaattctgacgcgctgttttgaaaatacgtgtcgtctgtttcatagacgagccgtccctcttcaagcgaagggagactgctgttcggataaacggataagaatacgtcatcaaaaatcggcacttcgctgagcgcttcaatcatgtgataagggccgaggcggcagttaatgccgacgatatcagctccgagatccgcaatcgagcgcaatgcgtcagaaagcggcgttccgtcctgcaatacgccttgctcgtgcatggagacattgagcataatcggaagatcagtctctttgcgcgcgattttcagcacttcatgggcttcttccaaatcataatatgtttctaacagcaagccatccggctcttcatgcagcagcagatacaactgctcgcggaagctgcgcttaatttcgtcaagactgtacgcgtttttattaaatgtccgtatgccgcccatcgttccaagcacgtatgcatcgcctgctgaagcccgcgcgatctttacggcctcctgattcatttttttgatgtcatcctcaagaccgtgtctggataatttaatatagttggccccgtacgtattcgtttgaataatgttggctcccgcttcaacatacgctttatgtatgcgctgaatttcctccggctttgaaatattgagctcctcaaaacacctgtcaatgccataggagtagaggagtgtccccatggcgccgtcaccgattaacacctgtctttgcaaatcttctaaaagtcccattgtctgcctcctttattcacgtcagcaaggaaaaaagagaaataaaaaaagtcctcttaagaagaagactttgtcagtgattttgtctcttcttatcttccaagctgttcgagcttgctggatttagcaccttggtcatggctgatcgccattacaccggttgctgaagcttcgtcgggccagtccctctgcttctcttgataagaacggatatgaaattttcgtgtcaggaagtgccaaaagatacctggcgtttttccctttctccaaatttaccgaaaataaagacaataatcaataggaatcagaaaatttatctgaaatttataaattgaacgtcaattggcaggtctgctccccgcacagctgagataatctgctgcaggtcatctttgttttttccggtgacacgcacttgatcatcctgcacctgagactttactttcagtccggagtttttgatgatcgtattgattttttttgcgttgtccttgtcaatgccttgaacaagctttgcacgctggcgtaccgttccgcctgacgcgttttcaaccttgccgtactcaatgttttttgtcggtacgtttcgtttaatcaatttgctgaccagcacatctttcagctggcttaatttgaagtcgtcatcagaaacgaggaccagctcctctttatctaaagaaatgtcgcttttgctgcctttaaagtcgtatcgggtactgatttccttcagtgcgatttggattgcgttttgcacttcaggcaattccaccttggatacaatatcaaatgagctttcttttgccatatgaaaacctccataacatttaacttatgtgttgattatagtagaataaagagaaacttccaacagaacaaagaatcaatttgtgatgattggaaaaaatgttaacaaaatccgcagagaataagcggaacaggaaggacgatagcatgagaccagggcagcaattaaccttgagtatagatcaccaaaccgacttcggttactttttaaccgatggggaagatacgattctcttacataacagtgaaatgactgaggatatcgaggacagagacgaagtagaagtctttatatacgtagaccagcaggaaaggcttgcggccacgatgaaaattccggtcatcagcgcggatgaatatggctgggttgaagtggtggataaagtggaagatatgggcgttttcgttgatgtcggtttatcgaaggacgcactagtcgcaactgagcatttgccgccgtacgaagatgtctggccgcaaaaaggggacaaactttactgtatgctgaaggtgacgaaccgggggcgcatgtttgcgaaaccagcgccggaagatatcatcagcgaactgtttaccgacgcttcagaagatctgatgaataaagagctgacaggtacggtgtacaggctgatcgcatcgggttcattcgtgatcacggatgacggtatccgctgttttattcacccgtcagaaagaaaagaggagccaagactcggttcaagagtcacgggacgggtgattcaagtgaaagaagacggttcagtcaacttatcgctgcttccgagaaaacaggatgcattgtctgttgatgctgagtatattctaacgtatatgagaacgagaaacggtgccatgccgtacagtgacaaaagccagcctgatgatatcagagaacgttttaatatgagcaaagccgcctttaaacgcgcgctgggtcatttgatgaaaaacggaaaagtgtatcaggaaaatggatggacatacgagaaaaaatagcatgaaaacggctcgcctgcagcagactgcggagcgagccgtttttttatgtctagtttaattcatcaaccagtgttctgattgccatttcgcgatccacattgtctgaaatcgctattggtgtaatatcaatggcgagaatgatcagaatcagggcacctgctgcagcaacataagaaacataatagaaatagttagcggtatcaacagtgttgacaagctcggcctgaactctggatgtatcatccttggaagcggcgatttcctttgcagcttctactttttcttcaacgatttgacctgcttttttcagcagttcatctactttcaatgcatctttgctgtaaacagctttcttcaggttatcaaaaaagtcagcatcctcttttttaatatcagcgacaacctgattggcaaaagcctttgcctgttttgtgttgagtttgtctgtcatcgctttattaaagacctctggcagctgtttgccaacttccccttgggcaaacacaaagcctttaaaaatttcctcacctgaatactcaagctgctttgcctgtgccacactttcttgctgcttcaccaaaaacacagtcgtcaccaatacaaccgacaaaaatactagaaacgccttcttcaaactgaaacctctcccttcttgtgttttttattccacaacagtctgcgaatatatgtaaattgaatcgtggaatcgataggagtgagatacaatatcaaaatgccggccatgataatcgaaaaactgatgaggcccagcatgactgcaaaaatctcatgcataaaaacagcgatgatcaaaatcaatctccaatgcttcttcggcgcaaacagcgccgcgaagatgacaatttgaaccagcaacgtcccccatgtcggaatcaccacgaacggacttgttacaattggcttcgttaacgcctgaaaaaagccgttgaagccaatggttttttcctgggcaaaataatagacggccgttccgtccacccattcctgctgagacagcttagcgacggtagagtgaaaataaagtaccgccacttggattctgatcacaaaataagaaataaaagctgttatttttccaagtgttcttttgccctctataggtctcgtgctccaatgccattttctcggatcggtcagcgtgatgggaagcaataaaaaggtcatgacggcggctgcctgctcgcctccgtcgatgacgatcagcgatgactgcaggctgtaactgacataccaatgcagaaccccggtgattctggggcgccagccaatgacaacaagcaccagaatggcaatgcagacccatctgaaaagatttaacatcatatagttattttcaccaaggcaaaagagactgagattcattttacaagctggatagctgctgataccgctggctggcttcataatgaggctcgggtgattgatgagcagcgtcagcaggctggatagcgcaatgatgcttcgcacgaggccgtatacatttgtccacgggtttctttcgtcccatctggtgatggtctgttttatgttttcgagcatgaaatcacaaccttgactatgctttttacctgataagacgaaggggtgtatttagaatagctccaaggaacaatatcctctttcgtcaaatagtagctgccacaaagcagtgggcggggagcgggtgtttttaattgcacggttttggctttgcttttgcatgcgccgaggtccttttctttacatgctgtccactgttccttgccgacttggctgtagatcacgcccatttcaacgccttgtgaccgcccataccgatacaggccgaataggttgtcagccctcatattgggccatctgaccttggcgctggcattttcagcctcatataagccgattgcagtatcacgcggatttttgctaaaaaagccccagccctgagggaggatgctggacatgagaaatttggagtcctttgtcagcggaatcggggttgtccctaagctgccaataatagaaaacagaaatagcgaaccccaaaggattgaaaaaatgacaaaaaatgatatcgatttctgcattcgactgctccttttaacctgaagaatcgtttttacacttttcataatataaaaacatttatgtaataaaaaggttaaaaagtatgagaaattccatttttgttaaaaggaaaaacaggacattttacactgctatatgtgattgatatatagtggttttttcgatatatttaaaccatgaaaacgaatcaagttaatgaccgctggattgttcaatttcgaaaagggattttcgagctggccatcctatcccttctgcgttctaaaccgatgtacggttatgagctgacgtcatccttaaaaaccacctcggcgctggctatttcagagggagcgatttatccgattctgaaacgtatgaccgagaagggatggatcgaatttttttgggaagattcactggacggcccgaaaagaaagtattacaaaatgacgcaaaaaggagaagaaatgttaaaagaacggctggagaaatacctggaaacccatcaagccttactgtctttatcgggggatttgctatgaatggacagcttatcattgaccgatacatggaggaactaaatgcagagctggcgaatatgcctgatgtagagagagaaaacgctatcgacgaattaaaggggcatatcaccgctttcgttcaagacagaatcaaagccggccttagtgaagaggaactgcaggaagctgttgaatctgaattttctcatccgaaggagcttgccgaattgatgatgggtgatgggggagagacgaaaaggaggaggtctttattgggcaaaagctggctttcggtccttctcattgtcacgattatcgccctgccgctgctgccgtccgacttcagacagctgccgctggctgtttatttaatggtgctcgccggatatgtatggaagcgaaaaaaattgatgatgtttgcaggtgtcagaaaaaacaaaatgcgctctcaaaaggagattgttacgatttcgcgagtcggtgcggtttatctgctgtttttagcagtgctgcttcttttgagcccgttcctcaatgcgcttgtcgtcctgctgctgattgcagtaagctgcgccgctttttttctttttcttaacatcaagtaatcttgtaggaggctgtaagatggaaatcagcatcaattatctattaattgtcatcgcgcttttattctttgtggttgcctattttgtcggaatcaaaaaacaaacctggatgctggctgggtttaacgaggcgcgtatacgggataaagaccggctggccagaatagcaggctactttttcttgaattccggtttgttcatattgctgaatagttttatctcatttcaaggtcaggagcagctcatacctccgcttatactggcatatggagcaggggttattatttatgtcaataaaaaattagtagagtagaaaaagaagggcagagcgaaatatctctgcccttcttttttgggaaaataagaacgaagcaccacatacaagtttttgtatttttgataggatgaacaaaaatggtagattccaaaataggaaggatgtggtgttttgcgcaacctgaccaagacatctctattactggccggcttatgtacggcggcccaaatggtttttgtaacacatgcctcagctgatcaaagcatcaaatacgaccatacgtatcaaaccccttcatacatcatcgaaaagtcatcgcagaagccggtacaaaacacaacccagaaagaatcgctattttcctatcttgacaagcatcaaacgcagtttaagctcaaagggaatgcgaacagtcattttcgcatttcgaaaaccataaaggatccaaagacaaaacaaacgttttttaaattaacggaggtttacaaaggaataccgatttacggctttgaacaagcggtcgcgatgaaggaaaacaaacaagtgaaaagtttctttggaaaggtgcatccgcaaatcaaggacgtctccatcacaccgtctatttctgataaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgatcctggctattggcattatttcatcgatgccaaaaacggaaaggtcattgagtcctttaatgccattcatgaagcggcaggtacaggaatcggcgtgtcaggtgatgaaaaaagctttgacgtcacagaacaaaatgggcgcttttatttggctgacgaaacaaggggaaaagggatcaatacgtttgacgcgaagaacctgaacgaaaccttgtttacgcttttgtctcaactgatcgggtatacgggcaaagaaatagtcagcggcacgtccgtatttaatgaacctgcggctgtagacgcacacgcaaatgcgcaagccgtttacgattattacagcaagacatttggccgtgattcttttgatcgaaacggagcaagaattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggaattctatgagcaaacaaaaacagtcagactctgtgtcctgactgtttttgtttgctcattttcttaaaaagaatatcgccaatgtacctggaccggcatgcgagccgattgctgaactgattggatgcataatgatttctttcggcttgaacgcttcctcaatcaggtgtttcatgtccgtggctttttctttgttcgcggcgtagctgatcccgacggtttgatcgctccaatcatccccgcgctctttcataagctcgatgatccgtttgaaaagtttcttctgtccgcggattttttccagaggcacaagcttgccgtcctccatctgaagcagcggtttaatattcaacaggccgccgacaaaagcggacgttttggatatccggccgcccctcgcgagatatgttaaatcatcaacggtaaaaatgtgttcaagctggctgcaaaagttctttacagacgtttcaatttcttgtattgtattcccgttgatacagagatcggcagcatgccggacagccagaccgtatcctaatgaagcgcatttggaatcaatgacccgcaaatcgaaatcggggaattcctccttcacttcattggcgatcattacagctgtctgatacgtgccggagagacctgaggaaaaggcaatgtaaagagcgggatcacctgtttcggcatattgcaaaaacacatttttaatcgtttgcggtgaggcttgggacgtcttaggcgtttctccattttgcatcgcttcaaatatttgatccgcatgaattgtgactgcatcttcgaattctttatcgccgagagaaaccctgagcggaataaagccaatgcctttttcttcaaaataagaacgaggcaaatcagtggcgctgtcagcgatgagatgaactgtcatattgcttcccttctttccgttatcgctcgttatcatgagagttaagccaactatatcatattaatttgccaaaatcgtgttcaaatatttgttttaagggaaaacataataaagaagaaagagcggaggaacatgccatggtactagatcaaacaaaaaaattactcatcgtcatcatcggcgctttactcaatgctgccgggctgaacttatttttgatacctgcagatgtatatgccagcggatttacaggtgttgcccagcttttatcaagcgtcgttgatcaatatgcccccttttacatatcgacgggaacgctcttgttcctcttaaacattccggtcggtattttaggatggctgaaggtcggcaaatcgtttacagtgtacagcattttaagtgtcgcactcactactctgtttatggggatcctgccggaaacaagcctgtcacatgacattttgctgaacgcggtgttcggcggcgtcatttccgcagtcggtatcggcttaacattaaaatacggagcttcgacaggcgggcttgatatcgtcgccatggtacttgcaaagtggaaggataaacccgtcggcacgtatttcttcattctgaacgggattatcatcttgacggcaggattattgcaaggttgggagaaagcattatataccctggttacactatatgtgacaacgagggtgatcgacgccattcacactcgccacatgaagcttacggcaatgattgtgacgaaaaaagcggacgaaatcaaggaagccatttacggaaaaatggtgcgcggcatcacaactgttccggcaaaaggagcttttacgaacgaacagaaagaaatgatgattatcgtcatcacgaggtatgaactgtacgatttagaaaagatcgtcaaagaagttgatccaaaagcatttacgaacatcgttcaaacgacagggatttttggtttctttagaaaagactgacgaaagcaggtggaagtcgtgaaacggctgcttgtgatgctcctccccgtgctgcttttgataggctgcgggaaagatgagcagacagaacccgataaggaggtatcaggcggaatggagaatcaagaggttgttttatctattgacgcaattcaggagcctgaacaaatcaagtttaacatgtcgctgaagaaccaaagcgaacgtgctattgagtttcaattcagcacagggcaaaaatttgaacttgtcgtgtatgattctgagcacaaagaaagataccgttattcgaaagacaaaatgtttacgcaggcttttcaaaacctgacgcttgaatctggagaaacatatgatttctctgatgtgtggaaggaagtccctgagcccggaacctatgaggtcaaggtgacatttaagggcagggcggaaaatctcaagcaggttcaggctgttcagcagtttgaagtcaaataagaggctatggcgagtcgccatagcctttttttattgcagtttgtccagctgattttgaaattgatgcaactgttgacgttccgcatctgtcgaattggcatacgcagaagatacagcatttttggctctcagaatcgcttgctcctgatcgccttcctcaaagccgtttgtcaccatgaccgcctgttgaacaaatgattttgcctgctgaaacagttcatttctcatttaatattcatactgcctttcagccgagtctcgtgccgcggcatgctggtgagcttcttctaaagtagaccgatatggaaatcttgcggcgtgtagcccgatggagtctttaccctgctgaataaaccttctggatttgcttcgtttacccattttgagactgcccccttccatactttgacgagatgagtcgtcttcaatagtatggtggggtaaagtaaggtttatgagtgggaaaaattaatacggaccttctttaaagtgagaaatattctttcaaaaaccttgccacgccgtcctcttcatttgtggccgtagttcggttggcaatctgcttgaccgcgtcaattccatttcccattgcaacgccgcagcctgcaaattcaagcatttccaaatcgttatcctcatctccaaaagcaatgatccgctccctaggcacgccgtaataatcgctgattttctgcaggccgaccgctttattcatgccgcttttgataatttcaatgacatgccacggagcggcccatcttctatggtcgatcacctcggcatgcacatccgataaatatgagcgtattgccggcacatcctcttcctttgcatgtatgagtacggacgtcacatcttcaccgagattttcccgcaagtctccgaccgttacatttgttgtgttcatgttaaaggcatctatcaggtgctcatcatggtaatgaaagtatacgtcgtcaatcacttcagcaagcacgttatgtacgttgtagctctcgctgatatccacgagctgtttgacaacatcaagcggcagtgacgtatgataccgtccccagctgtcgtcttgcggatgatggacaaatgctccgttaaaattgacaattggcgttgtcagctccatctgctggtagtacatggaacttgaacgatacggacggcctgttgagatgcagacataatgcccgtcatcttttaggcgctgtatcgtctgaagggtgttttcagatatggttttatcatcctttaataatgttccatctaaatctaatgcgattaaatagggttttgtctccatgaaaagctcctttaaccttagattttgcttgttttgccttacttacagtgtagctttttaccatctttattgtctacatgttacacttatgattatggttatcctaaggaggggcacattgtgatacaaattgagaatcaaaccgtttccggtattccgtttttacatattgtaaaggaagagaacaggcaccgcgctgttcctctcgtgatctttatacatggttttacaagcgcgaaggaacacaaccttcatattgcttatctgcttgcggagaagggttttagagccgttctgccggaggctttgcaccatggggaacggggagaagaaatggctgtcgaagagctggcggggcatttttgggatatcgtccttaacgagattgaagagatcggcatacttaaaaaccattttgaaaaagagggcctgatagacggcggccgcatcggtctcgcaggcacgtcaatgggcggcatcacaacgcttggcgctttgactgcatatgattggataaaagccggcgtcagcctgatgggaagccccaattacgtggagctgtttcagcagcagattgaccatattcaatctcagggcattgaaatcgatgtgccggaagagaaggtacagcagctgatgaaacgtctcgaattgcgggatctcagccttcagccggagaaactgcaacagcgcccgcttttattttggcacggcgcaaaagataaagttgtgccttacgcgccgacccggaatttttatgacacgatcaaatcccattacagcgagcagccggaacgcctgcaatttatcggagatgaaaacgctgaccataaagtcccgcgggcagctgtgttaaaaacgattgaatggtttgaaacgtacttataaagcactaagttattaacaagagctgaatttacgttatactgtagaaaaaaggagtgagggaacgtggaagaagcattaaaagaaaacatcatgggcgccctggaacaggttgtcgatcctgagcttggcgttgatatcgtgaaccttggtttggtatacgatgttgacatggatgaagacggcttaacgcacgtgacgatgacactgacatcaatgggatgccctttagcgccgattatcgtggatgaggtgaaaaaagcattagcggaccttcctgaagtgaaagacacagaggttcacattgtatggaatccgccttggactagggataaaatgtccagatacgcaaaaattgcgcttggcattcaataaaacaaaagaggacagcctgacatgtgaggctgtccttttttacagctgaaaggagtgaaaggaaatgatgtacctgctggcagttttgtgcccgccgcttgctgttttgttttcgggaaaaccgtttcaggccttgctgaatctcatattgacctgtatcttttggctgccgggcgcgattcacgcctgctttatcgtcgccgaccgccgtgccgaaaaacgggcaagaagataatttggaaaaatgaggacgcagtcatggtataatggtcataaaaacagcagggagagcactatgaaaaagaaattgcttgcattcgcgctttgtactggcgcgtatgcggccctgtttgcgtactctgtgaactcagagcaaaaaacagctacaagcgagatgacggatgtcagccgcctgatgtctgtaaaaataaagcagacagtgaaagggcaggaagaggaaacgctcattgacacagtcaaagaggcaaatcgaaaaaacataaaaatttcaatcgccggggcccagcactccatgggcggccatacatattatgaggacggcatcgttctcgacatgacgggctacaacaaaatcctgtcactcgatcaagagaagaaaaccatcagggtgcaaagcggtgcaacgtggaatgatatccagaaatacgtgaatccatacggactcgcggtaaaagtcatgcagtcacaaaacatttttacaatcggcggatctctcagcgcaaatgcacacggacgtgatattcgctacggctcgctgattgatacagtcaaatcatttcggcttttaaaagctgacgggacgattatcactgtcactccaaaagatgatttgtttacggcggtcatcggagggtacggcctttttggcgtgattcttgatgtaacgcttgagctgacagatgatgagctgtatgtcatgaagacagaaaaaatgaattacagcacatactcagactatttttcaaagcatgtaaaaggaaatccagatgtccgaatgcatctggcgcgaatttcaacagcgaaaaaaggatttctgaaagacatgtatgtcacgaattacgtattggctgatcatcaggatcaactgccatcatacagcgatctcaaagaagatgagtatacgggagccacaaagtttgcactcggtttgtcaagacggtatgaatggggcaggaattggctgtgggacacacagcaatcctattttctgagccaaaacggcacagagatttcacgcaataacgtcatgcggtccgaatcaaagtttcttgagtatgaaaacaatgacaacacagatgttttgcaagaatactttgtgcccgtgaaggagtatgggtcctatattgatgacctgagacaaacgctgtcggacgaagatctgaacctgctgaacattacgatccgctacgtgcagaaaaatgaaaaggccgacctttcctatgcgaaggacgatatgttttcgctcgtgctattaataaacgagggcttttcaaaagaagaccaggcagatactgcccgaatcatcaggcgcatgacagacgttgccatcaagcacggcggcagctattatctgccttatatgacctaccagacaaaagagcaaatgagacaggcatatccggaaagtgaagcgttttttcagaaaaaacgaacctatgacccggatgagcgctttatgaattacttttatcagaggtataaataatggggaaaaacaaattaaaatggctgacattatcacaaagcagcgtgtttttcgcaagcagcttaatctttccgttttatattctgtttgtgaaaaatatcggctcaagctacacacagttcggtttttcctacggattgtttgggttgagcggagcgctcatttacccgctcctcggacggctgtctgaaaggtttgacagccgttattttctgcttctgaactcgtgggggatggctgttctgcttttatatgtcccgcatatcggaagcgtcgttcaagtgtatatcgtccaagtgctgttagggctctttggagcgatgcaaaagcatggagaaaaagtgctgatcgctaattttacagacagcggagagcgtggaaagaagattgggaattaccatttttggacagctgtcttttcagcagcagccattatgctcgggggctttctcgctgactttttcacagtgcgaatgattttttatgcaagctctattctatattttttgagtggattgatgatgatgaaaacaggctgacgcggtcagcctgtttttttatgcggctgaaatgcggcgccgcatcaacgtttttgtgctggagttgtgctggtttttttgagtggaatttccattgaacagaaaatttataaatgaataaaaatattaaatatacgattgaattaatttttattcatgttataatgttaaataatttcacaaagaccaagagggtgaacttgttttgaaaataggaattgtaggtgctacaggatatggaggcaccgaacttgtcaggattctctcgcatcatcctcatgcagaggaatgcatactttattcatccagcggagaagggaatgtctatagcgagggttatcctcatcttaccggcttagcggatcagcagctgaagccgattgatatgaatacgatcaaacacgaaatagatatcatgtttctcgctgcgccgcccggagtatcaagtgaattgactccaaagctggcagacgcgggaattccggttattgatctgtcaggtgatctgaggatacaagaatcggctgaatatgaaaaatggtataaacggacagcggcaccgaaggcggtgattcaagaggcggtatacggtctggcagaactgaatcaactgcaaattcaacaggcgaaactcattgccaatccaggctgttttccaacagctgttttgcttggcctcgcgccattggctcaaaagaaactgctcgatgaatctttcgttatcgttgacgcgaagacgggtgtttccggagcgggaaaaaaagcatccatgggaacccatttttctgagctgaacggcaattttaaaatttataaagtcaatgaacatcagcacacgccggaaattgagcaggcgctgaatgaatggcagccaggcctcgggcccattacattttcggctcacttggttccgatgacaaggggcatcatggcgacgatgtataccagattaacctgtgatctatccgcagatgacctgcatgatttatattcggaattttaccaagattcatattttgtgagagtgaggccaaaaggtcagtacccgcaaacgaaagaagtgtacggcagcaatttctgtgatatcgccgtgaccctcgatgagagaacgaacagagtcacgatcgtctcggtaatcgataatttaatgaagggtgccgccggtcaggcagtgcaaaactttaatttgatgaatggctggaatgaagaaactggactcaccatcacgccaatttatccatagaacgggagagaatcgaaccatgattcagttaagtgaagatcaaattgtaaaagtaacaggtgatgtatcctcaccaaaaggatttcaggcaaagggtgtgcattgcgggctgcgttactcgaaaaaagacctcggcgtcattatcagcgagacaccggccgtgagcgcagcggtttatacccaaagccactttcaggctgctccgatcaaagtgacacaagacagcttaaagcacggaccgacactgatagccgtcatcgtcaacagcgccattgccaacgcctgcacgggagaacagggcttaaaggacgcatacacaatgcgggagagctttgcttcacagcttggcattgagccggagcttgtcgctgtttcatcaacgggtgtcatcggcgagcatttagacatggaaaaaatccacgcggggatcgagctgctgaaagaaacacctgcgggatcaggcgattttgaggaagcgatcttaacaacagatacggtgattaagcagacgtgctatgagctggcaatcggcggcaaaacagtcacgatcggcggagcggccaaaggctcagggatgatacatccgaacatggccacgatgctgggatttgtgacaactgacgcggcaattgaagaaaaagcgctgcaaaaggcgcttcgggaaatcactgacgtttcatttaaccaaatcacagttgacggagaaacatccacgaacgatatggtattagttatggcgaatggctgcgccgaaaacgagtgcctgacagaagaccatccagactggccggtctttaaaaaagcgctcttgctcacttgtgaggatctggctaaagagattgccagagacggagaaggcgcgacaaaactaattgaagcacaagtacagggagcgaaaaacaatcttgatgcaaacgtcattgccaaaaagattgtcggctcaaatctcgtgaaaacggcagtatacggaacagatgccaactgggggcggatcatcggagccattggacactccgcagctcaagtgacggcagaagaagtagaggtttatcttggcggccaatgcctgtttaagaataacgagcctcagccattctctgaatctctcgccaaggaataccttgaaggagatgaaatcaccattgtcatcaagatggatgaaggggacggaaacgggagagcgtggggctgtgacctgacctatgactatatcaaaattaacgcgagctatcgcacgtaataaaggggagcgaaatgaagaaaacaatcgtttttaaatgcgggggaagcgtcatccgtgagctgtcggaggaattttttcaaaatctgaaagagctgatggcgtcaggctggaagctggcgatcgtacatggcgggggaccggaaatcacgaatatgctgaaacggttaaatatcaagacagagttttcgggcggacagaggaaaacaacgaagccggtgctggaagtggcggaaatggttttatccggttctgtcaataaatttttcgttgctgagcttgccaaacacggactgcgagccgcaggcatttctggtaaggatggaggtcttttggaggctgattatctagatccggaaacatacggagaagtgggagaaatcaaaaaagtcgatgcgtccatggtgaacgcgctgatggaaaatggcatcatcccagttattgcgccgctgtctatgacaagcgactgcaaaacgctgaatgtaaatgctgatctggctgcttcagcagtcgccggagcgcttgaagctgataagctgatgttcgtcacggatgtcgatggaatcatgaaggaaaagcagcgtctggacgtcctgacccctaaggagattcagatgctgatcaagcaggaagtgatcacaggagggatgatcccgaaggtcaattcagccttgtcagctttatcagatcaggtgtctgaagtcatgatcgtaaacggaaaaggatcattcttcgcagaacaaacctttcaagggacaaaaatcgtcaaagcaaaggaggctgtttcatgagcagcttgtttcaaacctacggccgttgggatattgacatcaaaaaagcaaagggaacgtacgttgaggatcaaaacggcaaaacgtaccttgatttcattcaggggattgcggtatcaaatctaggacactgccatgaagcggtgacagaggcagtcaaaaaacagcttgacagcgtatggcacgtatccaacctgtttcaaaacagtctccaagagcaagcggcgcagaagctggcagcgcatagcgcgggagatcttgtctttttctgcaacagcggcgcggaggcgaatgaaggtgcgataaagcttgccagaaaagcaactggaaaaacaaaaatcatcacttttcttcagtcgttccatggccgcacgtatgccgggatggctgcgaccggacaggataaaatcaaaacaggcttcggcccgatgcttgaaggctttcactacctgccatacaatgatccttctgcttttaaagctcttggggaggaaggcgatattgccgcggtgatgcttgaaacagtgcagggagaaggaggagtcaatccggcgagtgctgaatttttatcatccgtacagtcgttttgcaaggaaaagcaagtccttcttatcattgatgaaatccagaccggcatcggacggacgggaaaaggcttcgcatatgagcacttcggactctcaccggatatcatcacagtcgccaaaggattgggaaacggctttccggtcggcgctgtcatcggaaaaaaacagcttggagaagcgtttacccctggttctcacggaacgactttcggaggaaacatgctggcgatggctgctgtgaatgccacattgcaaattgtattccagcctgactttctgcaagagactgctgacaaaggggcgtttttaaaagaacagcttgaggcagagctaaagagcccttttgttaaacaaatccgcggtaaaggattaatgcttggaattgagtgtgatggcccggttgctgacattattgctgaattgcagacattaggcttgcttgtattgccggccggcccgaacgtgattcggctgctgccgccgctcaccgtgactaaggatgaaatagcagaagctgtcagcaagctgaaacaggcaatcgctcatcattccgctgtaaaccagtgattttttttcgatacaaaggcataaaaattcatttttataattaattattcatcaagaggtgggctgttagatggaaggttatttagtgttagaagatgggacatcgttcagcggcgagctggacggtcatgaaaactgcacgggagaagctgtttttttcacaggaatgacaggctaccaggaagtgctgacagatccatcatataagggacagattattgtatttacctacccgctgattggcaactacggcataaatgaaaaggattttgaaagcaagaaaccgcaagtaaaagccgcggttgtctatgaggcgtgtgatcacttttctcattatgaagcggtatacagcctcaaggagtatttacagaaatggaacattccgctgttaacccatgttgatacgagggctgtcgtgaagaaaatccgggcaaacgggacgatgggtgcgacagtcacagcctctaaagaaggagctgagattgcccttcaaccagagaatgtggcagagcaggcttccgcccaggaaattagcacatttggcgacgggaataaacatatcgctctcattgattttggctataaaaagtcaatcgcatcatcacttgtcaaacgaggctgcaaggttaccgtggtgccataccagcaaatggaggacgtatacaacatcaaacccgatggcattgtgctatcgaacggacctggagatccgaaagcaatccatccatatttaggaaagatcaaaagcatcatcagccgctttccgactctaggcatttgtctcggacatcagctgatcgcgctcgcgtttggagggaatacttttaagctgccattcgggcacaggggagctaatcatccggtcatcgaccgtgagacgaaacgggtctttatgacaagccaaaaccacagctatgtggttgatgaacagtcgattaatgaagaagagctcaccatcaggtttcatcatgtcaatgatacgtcagttgaagggcttgcccataaaaaactgcctgtcatgagtgttcaattccacccggaagcccatcccggacctgcggaaagcgaatggatttttgatgattatctaaagaatgtgataccagcaaggagagaaatcgcgcatgcctaaagacaccagtatttcaagcatattagtaatcggctcaggcccgatcatcatcgggcaggcggcagaatttgattattcaggcactcaagggtgcatcgcgctgaaggaggagggctaccgggtcattctcgtcaacagcaatccggcgacaattatgactgatgaagccttcgctgatgaaatttattttgagcctctgacagcagaaagcctgacagccatcattaagaaagaacggcctgatgggcttcttgccaatttaggcggtcagaccgcgttgaatttagcggtggagcttgaagaaacgggtgttttaaaagagcacggcgtcaaactcctcggcacatccgttgaaacgatacaaaaaggagaggaccgggaaaaattccgttcgttaatgaatgaattaaaacagcccgtgccggagagtgaaattgttgataacgaggccgatgccctccattttgcggaatccatcggttttcctgttattatcagaccggcttacacattaggcggaaagggcggaggaatcgcccctgataaagaagcctttacagctatgattaaacaggcgctattagcaagcccgatcaatcaatgccttgtcgaaaaaagcattgccggctttaaagaaattgaatatgaagtcatgcgtgacagcaataacacatgcattaccgtctgcaatatggaaaatatcgatccggtcggcgtgcatacaggtgactctatcgttgtggcgccgtcacaaacattgacagacgaagactatcaaatgctgcggacagcaagtctgacgatcatctcagcacttgatgtcgtaggcggctgcaacattcaattcgcgcttgatccattcagcaagcaatattacgtcattgaagtgaatccgcgtgtaagccggtcatcggctctcgcatctaaagcgaccggttatccgattgcgaagatggccgcgaaactggcagtcggatacacccttgacgagctgaaaaatccgctcacaggctcgacttacgcaagctttgaaccggcactggactatgtgatcgtcaaatttccgcgttggccgtttgataaattcaaaaacgcagaccgcaagcttggcacaaaaatgaaagccaccggtgaagtgatggcgattgagcggaatttagaagcggcgatacagaaggcagccgcgtcccttgagttaaaaaatatcggaacacaccttccagagctcagcgggttgtcaattgatacgctatgggatttggcaatcactccggatgaccgcagatttttcgttgtcatggagctgttgagccgcagcgtgacgattgatgacattcatgcgaaaacaaaaattgatccgtttttcctgcatacctttaacaacatcatcaaattggaaaaccgcctgatggaagcagggagtgatctctcttttgaattattgaaaaaagcaaaggaaaagggattctcagacgcaacgattgcctcactgatcggcaaaacagaggtagaggtgcgcgcgcttcgcaaggagatgggcattacaccttccttcaaaattgtcgatacatgcgcggctgagtttgatgcgaaaacaaactatttttactccacatatttcggagaaaccgatggagacatcagccgcaaagagaaaaaacgcgcgctcattatcggatcaggcccgattcggatcggccaaggcgttgaatttgattacagtgcggttcacggcgtgctgacactgcaagagcttgggttcgaaaccatcatgattaacaataacccggaaacggtcagcaccgattatgaaattgcggatcgcctgtattttgaaccgatgacaacggagcatattgtaaacgtggcggagcaggagaatattgattttgcaattgtgcaattcggcggccaaactgcaatcaatgctgctgaagcactcgaaaaagccggcattacccttctcggcacatcatttcaaacgctcgacgtgttagaggatcgggatcaattctatcagcttcttgatgagctgggattgaagcacgcaaaaggagaaattgcctatacaaaagaagaagccgcttcaaaagcgagtgagatcggctatccggtgttaatccgcccatcttatgttatcggcggaatgggcatgatcattgttgactcgcaagcccagctttctcagctgctgaatgatgaggacagcatgccatacccgattttgattgatcagtatgtatctggaaaggaagtcgaaattgatttgatttccgacggcgaggatgtctttatcccgacatataccgagcatattgaacgggcgggtgtccattcgggggacagctttgccattcttccgggaccgtccatcacgagcgggctgcagcagggcatgaaagatgcggcacaaaaaattgcccgaaaactttcatttaaaggcatcatgaacattcaatttgtgatcgacaatggaaacatactcgttcttgaagtgaatccgagagcgagccgcacggttcctgtcgtcagcaaagtaatgggcgttccgatgattccgctcgccacacgactgctggcgggagcgtccttaaaagatctaaatccggcagttcaaaatcatcatggagttgccgtgaagttccctgttttttcttctcatgcgatccaggatgtggatgtcaagcttgggccggaaatgaaatcaacgggagaaggcatgtgtgtcgcatatgattctaacagcgccttgaaaaaaatctatacaagagtctggagtcaaaaaggaagcatttatttgcaaaacgttccggaagatgtgcaggagttagcagaaaacgcaggttttacaatacatgaaggaacatttgcctcatggatggaacaggaagggaaatcgctccacattaatctgagcggttctgaagaagcacgcaaagaacgtttggaagccatgacgcacggcatccccgtctttacagaagaagaaactgtgcgggcgtttttacaaagcggttctggccatccgcagcctgtatctctcaaagacctctataaaaaggaagtggcatcatgcacacagtgacgcaaaccagtttatacggaaaagatttattaacgttaaaggaccttagtgaagaggatataagcgccttgctcgcagaggccggtgagctgaaacaaaacaaaattcagcctatattccatggcaaaaccttggcgatgatttttgaaaaatcatcaacgcggacacgtgtttcatttgaagcgggcatggcgcagctcggcgggaacgccctctttctaagccagaaagatctgcagctggggcgcggtgagactgtcgctgatacggcaaaagtgctgtcaggctatgtggatgccatcatgatccggacctttgaacatgaaaaggtggaggaacttgccaaagaagctgacattccggtgatcaatggacttaccgataaataccacccatgccaggcgctggcggatctcttgacgattaaggagataaaagggaagcttaaaggcataaaagtcgcatacatcggtgacggaaataacgtggcgcactccttgatgatcggctgcgcgaaaatgggctgtgatatctcgatcgcttcgccaaagggatatgaagtgttagatgaagcagctgaagcggcaaaaacatatgcacttcaatccggctcttctatcacgctgacagatgatccgattgaagctgtaaaagacgcggacgtgatttattctgatgtgtttacaagcatggggcaggaagcggaagagcaagaacgtcttgctgtctttgcgccttatcaggtgaatgcggcgcttgtcagccatgccaagcctgactatacatttttacattgtctccctgcgcatcgtgaggaagaagtgactgcggagattattgacgggccgaactctgcagtgttccagcaggcggaaaaccgtcttcatgtgcaaaaagcactgctgaaggccattttatacaaaggggaatcatcaaaaaactgctgagccaaactcagcagtttttttgatggcaacatattcacagccgcttaggcgcatactacagcaaaaaggaaaaggaggaaaaacagtgggacagcagcaccaattccggcccggacagaaagcgcctaataacggtgtctacgtagaaatcggcgagacagggagcatggttaaaaaccctcaaaaggtccatctgtcagcaggggaaatgtttcccgaaacatcaaaccacaaccggctgtggacctacaaaagaaagccgtgaccactaaaaaacccaaaacaataaatgttttgggttttttggctttttaatgctggcttgcatttttgttcataggcatgatttctgctaaaaccatgattaagacatacagtacaacagcaatgacagatgatgttttgaaattatacgtaacgctgttcatgcttgcaaccaagtagcatgccatatgtgataaaaggaacgtccaaataaaggcaataatatatcgcacgtttccacctcgtccttctcattctattctaaaagttatcataccatacaaaaagcgaagggggaatccaattttagcagaaagtgaggtgacaaaagagtctgattcgtcacactttaatggtaaaatataaaacgtcaatcagtataatagccaaaaatgtaaaaggctaggactttaccttattcgtttcttttctatttacataagatagcgtgagatgaagtgtgaaaggaggcgggcaagcgatgggaataacggaaagatactttcaactgggaacggagcataatgtcattcatctgccctatcgcccgaacggcttcggcatctttatcttgggggacagaacccactttgtcggacatgattcaagcttttggcagcagcattatggcagaaatcagcttctgagcatgttgatgaatgaaggatacactctttttaacagcaatctgttcggaaggcattggggggcggaaaaagcagtcacctatgccaaacagctgatacattctgtgctgaagcaggaaatcctcaatccgaagattcatattttagcagaaggcatgggtgctctcgtggccgatgaactgcttcgtttttccccggatcatatccgctcagccgcaatgttgaatccttgtctcgatcttcaggcacattatgaatcggaaaaagaaaataaatttttctataagcaatttttgaaagaagtatcgaaaagctacggaatttctgaaaaagaagcggaagcgattcgttataaaacaattcaaagctacccgagcggcgtaccggttcatatatggcagcgtatgaccggagctccatatccctacagtgtacatgcggaagttttcaaggaaaaacagcaaaagcaaggctcaccggtcgacatgacatttcatttatttgagcatccaagcagaatttatgcatcaatttgcaaattctttcatagtcatgaaaaagaattatagagaatataatgacagcagccttctcttttgcggaggctgttttgttttgggaaatgaaaaaccggaagggcggcagatgcaatggaatcaacgctgattgtaggtgcggacgaatttttcggcctttcattatgtgagcgaatgatggatgaaggcatacatgttgacgttgttctggcggaaacagaagataaaatgagacaaatgtacttagaagaaagactcatgtggcttgggagaaatgaactctttcgccagcttgaacacattggagaccaaaattatgatacaatttgtatccagttcggaagttttttgcctttagaccaatgtgattctccttatattttagtatatgaagaagaccgaaaagaatgggaaaaacgtgaaaaaacaggctcggaaaaaaccgtgatcctgccgaaaatgtatgggccatggaaagaagaaacagaggaaaaaggctattacacaaacgacgtggctgacgagttgctgagattcctgttagaaccaagccgtcatagcaaagatcagctttttgaattgcaagtcacagaaaaaacctcaaaagaagaagcaaaaacaaaaattatagattggaaaagacaattttcatcaattttcgacaaatattaagaaaaaccttccatgtttcgagttttctagatacaataaacgtataaaaataatacatgttatagcttgtcaaaaggagttgaacatgacttgatcacaaggcttgtcatgatcttttctgtcctccttttattgagtggatgtggacaaactccgttcaaaggaaaaattgagaaggtcggcatgctctttcctgacacgattaatgacctcgtatggggcacaaaagggtataaaggattactgaatatacaatccaaatacaatgtggacgtctattataaagaaggcgttaaaacagaagaagatatcgtaaatgcgattgaggattttcataagaggggtgtcaatctgctctacggccatgggagtgaatatgctgaggtgtttaacttggtcggcgaagattatccagatatggaattcgtcatttccaatgcgaaagcgaaagctgataatgtaacgagtgtccattttagcggggaagcaatgggcttttttggaggaatgactgctgcccatatgtcgaaaacgaatcaggtcggtgtaattgcttcctttacgtggcagcctgaggttgacggttttatcaaaggggccaagtatgaaaatccggatatagaggtaaatacgaaatatacggatcattgggatgatgatacaacagcagtaaagctttatcagaaaatgaagaacgaaggcgcggatgttgtgtatcccgccggagacgggtataatgttcctgttattcagcaaatcaaaaaagacggtctttatgccattggctacgtcacagatcaatcggatctgggcgagaataccgtattaaccagcacggtgcaaaatgtggacaaggcctatgaaatcattgctgaacaatttaacaaaggcacccttgagggcggcgaccattactacgacctgaatacgggagtcgttgagatggggacattcagcccgctcgtcgataaagactttcagcaaagaatcgccaagctgatcaaaacatacaacaaaacaggcgagctgccaaaaaacgaataatggagtgacgtcacatgcagcacgaaaaatcacttgaattcttgcaaattgccatgaaatatctccctgaagcgaaagaacagcttgagaaatcaggcattgagctctcaatggaggccatccagccgtttatgaatctatttacaacggtaatggcggaagcttatgagcttggcaagtctgacgctaaatctgaaacagaataagaagaagccacttttttgaaagtggcttttcacatgattttctttttaatagcggagagcatgggcgcaagctcctttaaagcgggcttgatttgatcaagagagttcataattgaaccgatttggtccataatatgcatgtaatgaatcgtctcttcgtcgtttgtctgagaaacctgagaaacctcctcttgctgttcctccttctcttctgttggttttgctgcatcgccgaacatcattcttgaaaacacatccaactgcatacgcctcctttccatataccatactctatgagtaagatgaactgatagtttagacgaatatattgccatgtgaaaaaaaataggatagaattagtacctgatactaataattgatcacaacctgattgatcttctaaatttaagatataaaggagtcttcccttatgaaagctggaatacttggtgttggacgttacattcctgagaaggttttaacaaatcatgatcttgaaaaaatggttgaaacttctgacgagtggattcgtacaagaacaggaatagaagaaagaagaatcgcagcagatgatgtgttttcatcacatatggctgttgcagcagcgaaaaatgcgctggaacaagctgaagtggctgctgaggatctggatatgatcttggttgcaactgttacacctgatcagtcatttcctacggtctcttgtatgattcaagaacagctcggcgcgaagaaagcgtgtgctatggatatcagcgcggcttgtgcgggcttcatgtacggggttgtaaccggtaaacaatttattgaatccggaacctacaagcatgttctagttgtcggtgtagagaagctctcaagcattaccgactgggaagaccgcaatacagccgttctgtttggagacggagcaggcgctgcggtagtcgggccagtcagtgatgacagaggaatcctttcatttgaactaggagccgacggcacaggcggtcagcacttgtatctgaatgaaaaacgacatacaatcatgaatggacgagaagttttcaaatttgcagtccgccaaatgggagaatcatgcgtaaatgtcattgaaaaagccggactttcaaaagaggatgtcgactttttgattccgcatcaggcgaacatccgtatcatggaagctgctcgcgagcgtttagagcttcctgtcgaaaagatgtctaaaactgttcataaatatggaaatacttctgccgcatccattccgatctctcttgtagaagaattggaagccggtaaaatcaaagacggcgatgtggtcgttatggtagggttcggcggaggactaacatggggcgccattgcaatccgctggggccgataaaaaaaggtgaggtgcacacaagatgactaaaaaaagagtagttgttacaggacttggagcattatctccacttggcaacgacgtcgatacaagttggaataacgcaatcaacggtgtgtccggaatcggtccgatcactcgtgttgacgctgaagaatatccggcaaaagttgccgctgaattaaaagattttaatgttgaagattatatggataaaaaagaagccagaaaaatggaccgctttacacaatatgcggttgtggctgcgaaaatggcggttgaagatgcagatcttaacattaccgatgagatcgcgccgagagtcggtgtttgggtaggctccggtatcggcggacttgaaacactagagtctcaatttgaaatcttcttaacaaaaggcccaagacgggtaagcccgtttttcgtgccaatgatgattcctgacatggcgacaggccagatttctattgcattaggagcaaaaggggtgaactcttgtacggttacagcatgtgctacaggaacgaactccatcggtgacgcgtttaaggttattcagcgcggcgatgcagacgtgatggtcacaggcggaacagaagcgccgctgacaagaatgtcattcgccggctttagtgccaacaaagcgctgtctactaatccagatccgaaaacagcgagccgcccgtttgataaaaaccgtgatggctttgtcatgggggaaggtgcagggattatcgttcttgaagaacttgagcatgccctggcccgcggcgctaaaatttacggagaaattgtcggctacggctcaaccggagacgcttatcatatcacagcgccggcccaagacggtgaaggcggagcgagagcgatgcaagaagccattaaagatgcaggcattgcacctgaggaaattgattacatcaatgctcacggaacaagcacgtattacaacgacaaatacgaaacaatggcgattaagaccgtttttggcgagcatgcgcataaacttgcggtaagctctacaaaatcgatgacaggccacctcttaggagcagccggcggtattgaagccattttctctatcctggccattaaagaaggcgtgattccgccgacaatcaatattcaaacacctgacgaagaatgtgatttggattatgtgcctgatgaagcccgcagacaggaacttaattatgttctcagcaactcattaggattcggcggacacaacgcaacattaatctttaagaaatatcaatcataatcaagccaaaccggctgcccttaaagggtagccggttttttttgtgtgcataggattaaaagaggaggcgatcacatgagtgtagaacaaacatatagctggctcaggaaggctgattcaatagatgatttggcgcattacattatcccgcttttttcaggtgcggagaaaaagaactggaatggcattctgggacaccttcagcatcatgggatgtttaaaaacataaaagagggtattcagactgtttccaagctgaaggaaaaaggtttttacggacatatccaaaaggaagaacagtacctcaaaaacaaatggcaaggtcctgatgtaccaattgtcacgctgccggttgatgaacgaaacaggagaatccgtttagaattcggatcaaaatcaggactcgcctttcaagacaaaatgttcctttttctttcgtcagatttagattttgggtcggtatctgcccttatgacgcatgagtatcatcacgtttgccggttaggtcatctgacaaaagaggaaaaggatgtcacattacttgatacaatcatcatggaagggctggcggaatatgctgtttatgagaggttcggccgaagtcaaacggctgagtggacgacttggtatacaccggagcagcttcaggctttatatgaaaaaaagattgcgccccatcgggatatcaaacgggataatcgattatttccccagctgttattcggcaaaggatatcagccaaaaatgcttggatacgcagttggattcaatattgtaaaaaaatatttaactgccagcaaggcaagcaccgcagacggactgtccattcctgctgaaacctttttggatgcaatgctttaaaacgataaaataatggaatttcattaataatattacatttatcctaaaaaattcttgattttgcaaaatgtttgtaataatatacaactataaaatttttcgataattcaatattatttattatttctgaataaagggattgctttctcttgaaaacgtttgacaacaagaggggggaaaggggagctagcatgagcacacttttagaagtgaataatttaaagacttattttttcaggaaaaaggagccgatccctgcggttgacggagtcgattttcacatcagcaaaggcgaaaccgtcgcgcttgtaggtgaatcgggctccggaaaaagcattacttctttatcaattatgggcctcgtccaaagctcaggcggaaaaatcatggacggctctattaaactcgaagacaaagacctcacctcattcactgaaaacgattattgcaaaatccgcggtaacgaagtatccatgatctttcaggaaccaatgacctcccttaatccggtgttaacaatcggagaacaaattaccgaagtgctgatttaccataaaaacatgaagaaaaaagaagcccgtcaacgggctgttgaactcttgcagatggtcggtttctcccgggcggagcaaattatgaaagagtacccgcatcggctgtccggcggtatgagacagagggtgatgattgccatcgcactgagctgtaatcctaaactgctcattgctgatgaaccaacgacagcgctggacgtgacaatacaagcccaagtgctggagctcatgaaagatctctgtcagaagttcaatacatcgattcttctgatcacacacgacttaggtgtcgtgtctgaggctgccgatagagtaattgtcatgtactgcggacaagtcgtagaaaacgctaccgttgatgacttatttttaaaaccgcttcatccgtatacagaaggcctgcttacgtcaattcctgttatagatggagagattgataaattaaatgcgattaaaggcagtgtgcctacaccggataatctgccgccgggatgccgttttgccccaaggtgcccgaaagctatggataagtgctggacaaatcagccttcgcttttgacacacaaaagcggaagaacggtgagatgctttttatatgaggaagagggtgccgaacaatcatgacagcagctaatcaagaaacaatcttagagcttcgtgacgtaaaaaaatactttccgatccggtcaggcctttttcaaagaaaagtcggtgatgtaaaagcggtggatggtgtttcattttcgttaaaaaaaggagaaacactcggaatcgttggagagtcgggctgcggaaaatcgactgccggcagaacgatgatcagactgtacaaaccgacagagggccaaattctttataaagggcaggatatttccaatctgtcagaggagaagctgcggaagagtgtccgcaaaaatattcaaatggttttccaagatccatttgcttcgttaaacccgagaaagaccctgcgttccatcataaaggagccgtttaatacgcacaacatgtataccatgcgtgaacgaaacgaaaaagttgaagagctgcttgcaagagtagggcttcacccgtcgtttgccagccgttatccccatgaattttccggcggccagcgccagcggatcggcattgccagagcactcactttgaatccagagctgatcattgcagatgagccggtttccgcacttgatgtatccattcaggcccaagtgattaacttgatggaggaattacaggaagaatttaatcttacgtatctatttatctctcatgatctgagtgtcgtacgccatatcagcgacagagtcggagtaatgtatcttggcaaaatgatggaactgaccggcaagcatgagctttatgacaacccgcttcacccatatacccaagcgcttttatcctccgttccggttacaagaaaaagaggatctgtcaaacgtgaacgcattgtcctgaagggagaactgcctagtccggccaacccgccaaaaggctgcgtattccacacaagatgtcctgttgcaaaatcgatatgcaaggaacaaataccagaatttaaagaagctgctcccagccactttgtggcttgtcacctttatagctaatgttgcccgcacagctttgagagggggtatgcacactacataaacaacagctgagaagaacgaacatttcaagagggggaatatctaatgaaaagacggaaaaccgcactgatgatgctaagtgtattgatggtcctggccatctttttatctgcctgctcgggatcaaaatcaagcaacagcagcgagaaaaaatcagcaggcaaaccgcagcaaggcggggatttggttgtaggttcaactggggagccaacgttgtttaacccactctattctacagacgtttccagttcagatattgaagggatgatctatagtacattattagaaacggatgaaaaactaaatgtgaaacctgctttagctgagaaagtaacagaatccaaagatggcctgacttatgatgtcaaaattagaaaaggtgtaaaattccatgatggaaaagaacttacagccgatgacgttgttttcacttatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagatttaggcgaaaatgaatttaacaggaagaatccaattggttcaggtccattcaagtttgttgaatggaaaaagggtgattatgtaaaacttgaagcaaatgatgactactatggcggaagaccgtatttagatacagtgacagttaagacgattcctgattctaatgccgctgttgctcaattaaaagctggggatattgacttctttgttgtaccaggcacagactnnnnnnnnnnnnnnnnnnnnnnnnnnnnnnnnnnnnnnnnnnnnnnnnnnnnnnnnnnnnnnnnnnnnnnntggaatgaaaaaaatgaattatttaaagataaaaaagtccgccaagctcttacnnnnnnnnnnnnnnnnnnnnnnnnnnnnnnnnnnnnnnnnnnnnnnnnnnnnnnnnnnnnnnnnnnnnnnnnnnnnnnnnnntcttggaactatccaaaaggtgatgtacctacatttgattacaatcctaaaaaggctaaaaagctcttggaagaagcaggatggaaagatacagatggagacggttaccttgataaggacggaaagaaattctcatttaccattaaaactaaccagggtaataagattcgagaggatttagcagttgttgttcagcagcaacttaaagaagtaggaattgaagcaaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttatcatttgttttcttgatagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttaacatttttgataggctccatcatttaattttacctgcgtttgttttagcaactgcggatatggcaggtattactcgttatacaagatcaagtatgcttgatgtattaaagcaagattatataagaacagctcgagccaaaggattcaaagaaaataaagtgattttcaaacatggtttgagaaatggcctgcttcctgttattacaattttcggattgatgattccatcatttattggcggtgctgtagtagttgaacagatttttacttggccgggattagggaagttatttattgattcggcattctctcgagattatccggttattatggccatgactgtgatttctgctgttttggttgtactggggaacttgattgcagatattttgtatgcattagttgatccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggataagttaattttaattttttctctgacgggctggactacaacagcgagactagtcagaggcgagtttctatccctacggtcaagggaatttgtattggctgctaaaacaataggcacaaaaaatcacaaaattattttttcgcatatattgccgaattgtattgggccaattattgtttccgctactctaaaagtaggcagtgtcattctagctgaatcaacgctaagctatttgggtttcggtatccagccgccaattgctagctggggaaacatgcttcaggatgctcaaaactttacattaatgattcaagcatggtggtacccgttatttcccgggctatttattttaatgaccgttttatgcttcaactttgtcggtgatggcctgcgggatgcgcttgacccgaaaaatattaaataaaaatgaatatcatatctgttataaaatatcaccaaatcagaaaaaaagcaggtctccctttgtcagaaaatatacaaagagatctgctttttgtgattcttgcataaaaccagtgattccagatttcctcaatctctttggaataatttctctgtcccttgcctatactgtggacaacagtttttataaagtgaggggttagagatgttatttcttcatgatgtgtgggtcaattggtttgaaggggaagaaaatggctacaatgtatgccactttcacgaatggcgcaaggaagatacggttgagcttttggatcaggtaccgctgttaagggtgccgtcagtactgtttcattacatagaaaacgatttgtcagagcttccgaaaggtttgcttgaagacgtacatcagaaatcgtacattcggaaaaatcatgagcggacaaagcttgaatattgttttgtcgtaacagacggaatcggcattttggctgtcgacacgattggctatacaatccctgtcaggaaaagccgtctgatcccaagacaagagcagctcgtttatgaaatggtaaaggatgtagagcctgaagcatatgaatttgaaccaaagaagctggaatcctctaaggaatatcacatcttatcattagcaccagaacatgtcagaggactgacaagaaaagaacggcaaatcaagcagctgatgtttatggcgcttgaccaattgaaagggctgaaaaaccgggcggaaatcggctactggtacacagagtggaatccgcatatgtatgaacaaatcaaaaggatgagctttgaagagatttgggacatgctgtataacgaaacaattgaaggctggtcggacaagcacctagctttttgcgaaaacctaataaaaggacagccttttttcgaaaagctttgggaaatggaaaacgaatcaaaggtaaactgaaaaaaacaaaaccgctctttgcaaagagcggttttttaatcagcgtctttttcttccaagacccatggcattctccatttttttcagcattttgtttgctgtccggttcgcccgttccgcgccttcatcaagaatccggtctaattcttcagattctatcagttcaaaatagcggtcctggatcggttttaatgcgttcaccacgacttctgccaaatcacctttaaactcgccgtagccttttccttcgtactttgcttcaagctcttcaattgtcgtattgccgaggattgaataaatcgtaagaaggttggaaacgcccggtttgttttccttatcaaatttcacaatgccttcagaatctgtcacagcgcttttgattttcttttcaagaagcttcggttcatccagcagggtaatataagccttctgattcggatcagatttgctcattttcttcagcggatcattcagagacatgatacgtgcaccgacttttggaattttcacttccggaatcgtaaagatgtcgttgtattttttgttgaagcgttctgcaagattccgcgtcagctcaaggtgctgcttttgatcctcgccgacaggcacaagatccgttccgtacagcagaatatcagcggccattagcggcggatatgttaacaggccggagacaacagcttcattgcctttggatttgtccttaaattgagtcatccgctcaagctcgccgatataggcgacacactgcatcatccatccggcctgcgcatgcgcggggacctctgactgaataaacaatgttgctttttctggatcaagtccgacagctaagtaaagcgccgcgagattgcggatattctttctaagctcaagccggtcttgaggaacagttatcgcatgctgatcgacgatgcaaaaatagctgttataatcatgctgcagttcgacaaactgcttcattgcaccgatatagttgccgagcgtcactgagccgcttggctgaatgcctgaaaaaatcgtttgtttcatgaaaacatcaacctcatttcttaaaacataataaaaaaggctcattctttccctgtaaaaaagggacgaatgaaccgtggtaccaccctgattattccattaaaatgaaatcactctgacgtttgtaacggagactgctccggctgagcctacttttttccagttcggtcagctgctccaaagtccattccacattgcccgttatctgctcccagcaccgcagactctcttcaaacaggtgaaatgtgtactactctttttcatagcacgcttttcttttgattgcttcattataaatcaattataaccaattgtcatcatgaaaaaacattcttttttccagtaaaattgtaataatataaataacacgggtgctgtaaaatccttaaatgataactgctatcagcgtaaaaacagacagatattatatgtaaaaagcaatatgggcagaaaacacatgaaaaagtttttaatcaatttatgctttaaatggtagaaggatattatgttcatggaagaaaaactaacgaagtttaaatattttaaattgataaaataatattgcaataaattatttgtttcattataatgaacttgttcactctattgttacagcttttttacaaaaataatcagaaaagacggaacagaataaaagttgcggaaactcaggttcatttgtctgatatttctgaggatttagccgtaaggagctgaaaattattattagggggtttgcgaatatgaaaaaacgttggtcgattgtcacgttgatgctcattttcactctcgtgctgagcgcgtgcggctttggcggcagcggatcaaacggtgaagggaaaaaggacagtaaaggaaagacgacacttaacattaatattaaaactgagccgttctccttacatccgggattggcaaatgattcagtatcaggcggtgtcatccgtcagacttttgaaggattgacacgtatcaatgcagatggtgagcctgaagaaggcatggcttctaaaattgaaacgagcaaggacggaaagacatatacatttaccattcgtgatggtgtgaaatggtctaatggtgaccctgtaacagcacaagattttgaatatgcttggaaatgggcgcttgaccctaataatgaatcacaatacgcttaccagctctactacataaaaggtgctgaagcggcgaataccggaaaaggcagcctagacgatgtggcagtaaaagctgtgaatgacaaaacgctgaaggttgaattaaataacccgactccatatttcactgaattaactgcgttctatacgtatatgccgatcaacaagaaaattgcagagaaaaataaaaagtggaatacaaatgccggggatgattatgtatcaaacgggccgttcaaaatgacagcatggaaacacagcggttctattactctcgaaaaaaatgatcagtattgggataaagacaaagtcaaactgaagaaaattgatatggttatgatcaacaataacaatacggaactgaaaaaattccaagctggcgaacttgattgggccggtttgccgctcgggcagcttccgacagaatctctcccttccttgaaaaaagacggttctttacatgttgagccgatggcaggtgtgtattggtacaaattcaacactgaggctaagccgttagacaacgtcaatatccgtaaagcattatcttatgcgattgaccgtcaatcgattgttaaaaacattacgcaaggtgaacaaatcccggctatggctgcggtgccgccgacaatgaagggatttgaggataacaaagaaggctactacaaagacaacgatgtcaaaacggcaaaagaataccttgaaaaaggcctaaaagaaatgggattaagcaaggcttctgaccttccgaaaatcaaattgtcttataacactgatgatgcacatgcgaaaatcgctcaagctgtacaagaaatgtggaagaaaaatttaggcgttgatgttgagcttgataactcagaatggaatgtctatattgataagctccacagccaagattatcaaatcggccgtatgggctggcttggggactttaacgatcctatcaacttcctagaattgttccgtgacaaagacggaggaaataacgatacaggctgggaaaacccagaattcaaaaaattgctgaatcagtcacaaactgaaacagatcaaaacaaacgtgcagagctgctgaaaaaagcggaaggtattttcattgatgaaatgccggtagctccaatttatttttatacgattccttgggtacaagacgaaaatctgaaaggaactattattactggaactggagaaatttacttcagaaacgcgtactttcaataagtcttatttgtgaaaacaataacctcaaggtatatggggacctatttcccatatacctttcttactgaagaatataaaaaagtaaaaaccatggaggtgttcccccttgctaaaatatatcggaagacgtttagtctatatgattatcacactatttgtgattgtaactgtgacattcttcttaatgcaagcagcaccgggcgggccattttcaggtgagaaaaagcttccgcctgaaattgaagcaaatttaaatgcgcattatggcttggacaagccgctgtttgtacaatatgtcagttatttgaaatcagttgcaatgtgggatttcggaccgtcatttaaatataaaggtcagagtgttaacgacctgatcagttcaggtttccccgtttcatttactcttggagcagaagctattctcctcgctttagcgttaggtgtattgtttggggtcattgcagccctttaccataataagtggcaggattataccgtcgcgattttaacgatatttggtatttcggttccgagctttatcatggcggctgttctgcaatatgtgttctccatgaagcttgggctgtttccggtcgcggggtgggattcctgggcatacacctttttgccttcaatcgcacttgcttccatgccgatggcgtttattgccagactttcccgttcaagcatgatcgaagtgttaaacagtgattatatccgcacagcgaaagcgaaagggctgtcccgcccagcggttacagtgcggcacgccattcgaaacgcgcttttgccggttgttacatatatgggcccgatggccgcacaggtcttaacggggagcttcattattgaaaccatttttgggatcccggggcttggtgcacacttcgtcaacagtattacaaaccgtgattatacggtcattatgggtgtaacggtgttcttcagtgtcatcctgttattgtgtgtattaatcgtagatgtgttatacggcattattgatccaagaatcaagctttccaaagcaaagaaaggagcctaggccatgcagaacattccaaaaaacatgtttgaaccagccgcagcgaatgccggcgatgcagaaaaaataagtaaaaagagcctttccctctggaaagatgcgatgcttcgcttccgcagcaataagcttgcaatggtcgggcttatcattatcgtacttattatccttatggcaatttttgcgccgatgttctcaaggtatgattattcaactactaatctcttaaatgcggataagccgccttcaaaagatcactggttcggaacagatgatcttggacgggacattttcgtccgtacatgggtaggggcgcgaatctcaatctttatcggtgttgcagctgctgttcttgatttgctgatcggcgtcatttgggggagcatttcaggcttccgcggaggcagaacggacgaaatcatgatgcgtatcgctgatatcctttgggcagttccttcattattaatggttatcttactgatggttgttcttccgaaaggtctatttacgattattattgccatgacgattacaggctggattaatatggccagaatcgtgcgcggacaagtgctgcagctgaagaatcaggagtatgtgcttgcttcacagacactgggtgcaaaaacatcccgtcttctgtttaaacatatcgtgccaaacgcaatgggttctattttggtcacgatgacactgacagttcctactgcgattttcacagaagcctttttaagctatttgggacttggtgttccggctccgctggcaagctggggaacgatggcttctgacggattgcctgcattgacctattatccgtggcgtttattcttccctgccggatttatctgcattacaatgtttggtttcaacgttgtcggcgacggattaagagacgcattggatcctaagttacgtaaataagggagtgatacgggtgacacgcctattagaagtaaaagatttagcaatttcatttaaaacatatggcggagaggtccaggcgatccgcggagtgaatttccatctggataaaggggagacgctggccattgttggagaatcaggttccggaaaaagtgtaacctctcaagcgattatgaagctgattccaatgcctccgggttatttcaaacgcggtgagatcctgtttgaagggaaggatctggtgccgctgtccgaaaaagaaatgcaaaatgtccgaggaaaagagatcggcatgatatttcaggatccgatgacctccttaaatccaacgatgaaggtcggtaaacaaattacggaagtgctttttaaacacgaaaagatctcgaaggaagcggctaaaaaacgcgcggttgaactgctggaattagtcggtatcccgatgccggaaaagcgggtgaaccaatttccgcacgaattttcaggcggaatgaggcagcgggttgtcattgccatggcgcttgcagcgaatccgaagcttctgatcgccgatgagccgacaactgctcttgatgtaacgattcaagcgcaaattttggaattaatgaaggatttgcaaaagaaaattgacacgtccatcatctttatcacacacgatcttggtgttgtggctaacgttgctgaccgggtcgctgtcatgtacgcgggacagattgtagaaaccggtacggtagacgaaatcttctacgatccgagacatccgtacacttgggggcttcttgcatccatgccgacactggaaagttcaggagaggaagagctgactgccattccgggcacaccgcctgatttgacaaacccgccaaaaggagatgcttttgccctgcggagcccttatgcgatgaaaatcgattttgaacaggagccgccaatgtttaaggtatctgatactcattatgtcaaatcgtggctgcttcatcccgacgcgccaaaggtagagccgcctgaagcggtaaaagcgaaaatgcgtaaactggcaaacacgtttgaaaaacctgtcttagtgagagaaggtgaatgaattgactgaaaaattattagaaatcaaacatttaaaacagcactttgtcacaccaaggggaacggtcaaggctgtagatgatttatcatttgatatctataaaggtgaaacattagggctggttggtgaatcaggctgcggtaaatcgacaacaggccgaagcattatccggctgtacgaagcaaccgatggtgaggtgctgttcaacggcgaaaatgtgcacgggagaaaatcgcggaaaaagctgctggaattcaaccgcaaaatgcagatgattttccaagacccatatgcatccctgaatccgagaatgacagttgctgatattattgctgaaggccttgatattcataagctggcgaaaacgaaaaaagagcggatgcagagggtccatgaactattggaaacagttggtttaaacaaggaacacgcgaaccgttatccgcatgaattttccggcggccagcgccaaagaatcgggattgccagagctcttgctgttgatccggaattcattatcgcggatgagccgatttccgctttggatgtatccattcaagcgcaggtcgtgaatttaatgaaagaactgcaaaaagaaaaagggctcacatacctgtttattgcccacgatttatcgatggtcaaatacatcagtgaccgcattggagtcatgtatttcgggaaactggttgagcttgcgccggcagatgagctttatgaaaatccgcttcacccatatacaaaatcattgctttctgcgattccgcttcctgatccggactatgagagaaatcgcgttcgccagaaatatgatccgtccgtccatcaattaaaggatggggaaacgatggaattccgtgaagtcaaaccgggacattttgtgatgtgcacggaagccgaatttaaagctttttcatgattcatcaatccttcaagagaatctcttgaaggatttttttgcgtcctcatagaaagtgagaatgataacatttacaattagaggaaaaaagcggaggcgaaatacgattcaatttctgcataacaaaaatgtttttgcgctattgctgtctcaatcttttcaatctttagcaggagtcctcgtcacaatcgttttaatggtccgggtctatcaaatgactgactccgtttttttggcgggccttattttatcgttcatgtcgtttgcgagtatagcagcaagcttttgcgtctctccggtgcttcgcattctcggttttaaaaaggtgcttgcgggagcgaatctgctgagagcggtctttacaatcctgatggcatacagcgtcactcatcacggacaggcattcttttggattacgctgctgtttgtgttctgtttttccttcgcgggcgctttttttcagccggcaagatttgcgctgctgccgattattgttccaaagaagcaatatgtaaaagcgaatggtgtgatctccctctcgaatcaattgttcttaacagcaggctggggccttggaggccttctgacgtacgccgtcccttttgaactcgttgtcggcgctgccatttgcctgtttgttctatcgggagcttccatcagtgtgctgcatgtaaatgaagaagaggctgtaggaactgctgaaacagcatctgccagaagtatatggaaggatttaatgatcatccctattgtaagagacattactgtaatggacatgatagaagctttggcgggttccgtatggtcatctgctattctcctcgcatttactgcggctgttttgcatgaaacagaggtgtggtgggggatgtttaacgcttcctattttataggcgcaattgtcggcagtgtgattgccattcgtttttcttctttttttgagcggaatatgggctatgccattatgttcagctcacttgtaatgtcggcgctgacccttttgttttcattttctccagtcccatttttatgcgctctggcttgtgctgcaatggggcctttttatcaggtgcgtgatatttgccaggaaaccatgctgcaggaggttattcccgagcagaaacgaatcggaatcatggctgcaaaaaatgcgattttgactccttggtcaggcgtcacctactccattatggggctagtggctgatgctgctggtgcgaaaatagcttttatcgcggctgttgcattatatattatgacatttctgattgcactggcgcagccccgtctggttcattacaggcgggaaaatcgagttcaatgagaaacaattcaaaatgaacggagcagctggctccgtttttgctgaaaaaaaatgaaaccatggcggaagttcgcacgtctttatagatgtaaggctgtttaaacaagaagaaatggggtatatctaaaagtatgaagacaacgaactcataaggagcaaatcaatgaactggtatgaaaagcttagcgagtactttccaattgaagaaatgaaatcaaaagcgcatatggaagctcttctgaaagagcgaagcgatatttatcataaagatgaaggcaaacatcatattttaatgtttgcggaattcgattcttttatcttcgttgattatctgtatgtgtctaaggatgcaagagggcagggacttggcggcaaattgatcgcgaagctgaaaaagaaaaataagcccatattgctcgaggtggaacctgtggatgaagatgatactgatacagaaaaacgcctgaggttttatcaaagagagcatttcaagcatgctcagtcaattgggtaccggcgccggtcattggctacgaatgaagtaaacaagatggagattctgtactggtcaccgaaaacagaatcagaagaagaaattcttgaagccatgaaacagacatatgaaaacattcatacttataaagatgagaaatggtacggagaatcgtacgaaaaaacggatgaggtcttggaaatcatcgatgaagaaaaacaaaaaaatattttcgatcagttaagctaattgagaataagaacatatcatgaacattaaaaatttgctggattgacacatttttttcttaggatactgttcacacttacttttttatagtataatacctgtaaagattccttttttagagtaatttcaatttaagaataaaatagatgttcatcctactaattagaggagtgaagatgaatggttacactatacacatcaccaagctgtacttcatgcagaaaggcgagagcgtggctcgaggagcacgatattccatttgtagaaagaaacattttctctgaacctttatcaattgatgaaataaaacaaattcttcgaatgactgaggatggaacagatgaaatcatctcaacccgttcaaaagtattccaaaaactgaatgtgaacgttgaatctatgccgctgcaagatttgtaccgcttgatcaacgagcatccaggtttgcttcgccgtccgatcatcattgacgaaaaacgtttgcaggttggatataacgaagacgaaatcagacgtttcctgccaagaaaagttcgctctttccaattaagagaagcacagcgtttggcaaactaatagatcgtatcatcaaaagaaggctgagtcatcagccttcttttatttttcaacctgctggtaataaatgctcgcaagaatgacaaacgcaaccgtcaaaatggggaggagcgtttcaactgtgtcgtgctgcgccataaaaagcgacagctttttgtctctgacaatcatttctccgccagtataagcaagcagcccgcttcccgcgtaaatcagaagcggtattttctctagtgcaatatggatgagtttgctgccccaaataataaccggaaccgatacacacaaacctataacaacgagagaaaactcaccgtgtgatgctcccgcaactgcgatgacgttgtccagcgacataaagagatctgcaagcacaatcgttcgtatcgctctccacagggaggtgctgcttttaatgtgtttcgtgtcttttttttcaattagcagctgatatcctaaatacagcaggaaaattccgccggcgcactgcaagaacggaatgttcaaaagatatacagctgcacttgttaatccgattctcatggcaacggcaataaatgttccgagaataatggcttgctgtctttgcttgtccggcaaatgtctgctggccatggcaatgacaaccgcgttatctccgccgaggatcaggtcaatcccaacaatgacaagcagagaaatcagatagtcatgctccatgaagcggcacctcgctttcagtccttcgcttgtactactactatatgagacaggtcgtattttatgatatcagccgcctgaactgccgttttttaggcaaaggtgcatttttatttcttttgtgactgttttatcataaaatagaaatacaaaggaattcacactggccttggttaaggttaagatgtggacggaatgggtaaagtgtagtaaagtacaattaatcgggagcttagatgtcccttcaacatcttatatagaagggaaggttggcaaatggaaattgaaagaattaacgagcatacagtaaaattttatatgtcttacggagatattgaagatcgcggttttgacagagaagaaatttggtataaccgtgagcgcagtgaagaactattctgggaagtcatggatgaagttcatgaagaagaggaattcgctgtggaaggcccactttggattcaagttcaggcactggacaaaggattagaaatcatcgtcacaaaagcccagctttccaaagacggacaaaagctcgaactgccgattcctgaggataaaaagcaagaaccagcatctgaggatcttgacgccttgctggatgatttccagaaagaagagcaagccgtcaatcaggaagagaaggagcaaaagcttcaatttgtcttgcgatttggcgattttgaggatgttatttctctatctaatttgaacgttaacggaagcaaaacgactttatattcgtttgagaaccgatattatttatatgtagattttggcaatatgactgatgaagaggttgaaaatcaactaagcatcctgctggagtacgcaaatgaatcctcaatcagcatacaccgtcttgaagagtacggcaagctgattatttcagagcatgctctagaaacgataaaaaaacactttgcatcatagcaaaccgatttccttccggaaatcggttttttttatgcacgaaaatgccattttagagatgtgaaaaatcaaaaacatatagacaagcggaaaatacagcgaacaggagttgatcatcttttccagaaagtatacttcatctggaaaggagagatgacaattgtttagtgctgtgactgaagacggccaaatgtttcaccttctaggcgctcagcaaaaccagaaattaaagcggagacggttcttctgtccggtatgcggaggagagctagctgtgaagctcggacttcaaaaagcgccgcattttgcccataaacagaacaagtcctgctccatagacatcgaaccggaaagcgcctaccacttagaaggaaaaagacagctgtatgtatggctgaaaacacaacgggcttcaccaatattggagccgtatataaggacaatcaaccaaagaccggacgtcatggcaagaatcaaggagcatatgcttgctgttgaatatcaatgcgccactatcgctccagatgtctttcaaaagcggacagagggcttcaaacaagaaggaatcatcccgcagtggattatgggatacagccgcttaaaacggactgcttcgtccttttatcagctttcaacttttcattggcagtttatcaatgcaagtccatacagagaactgatatgttattgtcctgaaaggcgttcttttctccggctcagccacatcattccattctacacaaaccattcttattcctcagtccaaacgatccctattcatcgggcaggtgtaggcgatctttttttcactgaaccgaaaccctcaattcaatattcaggctggacgaaagcgattcaccgttttcgccataaaccccatcggtttaactcaaaggaaacaaatcgccttaggctgctgttttatgagaaacggcagacgcctttttcttttctgccgactgaagtgtttgttcctgttagaaaaggggcagtttttaagagtccggtttttgtgtggcaggggtttctttatttgtttatgacggatcttggagataaacgtgcgccaattcgtttttcagccgttttgcagcagtgcaaactgcacattcataataagaacattgcactcaggttcgaatgcagcgaagagtgtctttcagaagcggttaaacagtatattgattttttgtgcaagaagggatttttaagggagactcagaaagaagtatatgtgctgaatcagcctgcaggcggcatacactccatgcaggatctcatagaaagagaccgcagctgttttatagaatgagtttgtcttatttggctcaccctaagacaaaggtggtgggcaggctgtgaaaggcacaaaaggaaaggtttttcgtgtttttactgcttttttggcattcgttctcttcattactgcatatgatttgacaaaaggcagtgaaaaaccggaagatattcacaacacaagtttattgagaaacagctgttttttcaattggcttgaatcaaagaagacgagggggatcaccatggctgaggaaaaaaaagcaaaccaactgcctgacagaagtgaggtaaaggcagaagacacatggagacttgaggatatttttcctagtgatgaggcctggaataaagaatttcaagctgtaaaagaattaattccgaatttatctaagtataaaggaaagctggcagattcagctgatcatttatacgaggctcttacgtatcaagataaagtgatggagcggctgggtaggctgtacacatatgcgcatatgcgctctgaccaggatactgggaactccttttaccaggggctgaatgacaaggcgggaaacctgtatacacaggccgcaagcgcgacagcttatctggttccggagattttatccatagaagaagacaaactgcagcagttcattcttgaaaaagaagaattaaagctgtactctcatgcgattgaggagattacaaaggaacgtccgcatgtgctgagcgagaaggaagaggcgctgcttgctgaagcctccgaggtactggggtcatcttcaaatacattcagcgtgttaaataacgcagatattacgtttccgtccattaaagacgaagatgggaatgagaaacagatcactcacggcaactttattaatttcttggaaagtgaaaaccgtgaagtccgcaaaaatgcgtttgacgcagtgtataaaacgtacggacaatataaaaatacaatggccacgacgcttagcggcactgtgaaaaaggacaacttctacgcgagagtgaaaaagtacaagtccgcgcgtgaggctgcgctttctaacaacagtattcctgaggaagtatacgataaccttgttaagacgattaataagcatttgccgctcctgcaccgctatattgcgctaagaaagaaagtgcttgaacttgatgaagtgcatatttatgacctgtatacaccgcttgtgaaagatgcggggatgaaggtgacatacgaggaagccaaagattacatgctgaaaggcctcgcaccattaggggaagaatatgcctctatcctaaaagaaggcctggaaaaccgctgggttgacgtttacgaaaataaaggcaaacgcaatggggcttattcatcaggagcttacggcacgaatccgtatattttgatgaactggcataataacgtcaataatctctttacgcttgtgcacgagtttggacattccgtacacagctactatacgagaaagcaccagccttatccatacggcaattacagcatctttgtcgcggaagttgcctctacgacaaatgaagcgctccttggcgaatatttgctgaataatttagaggatgaaaaacagcgcttatatattctcaaccatatgcttgagggcttcaggggaacggtcttcagacaaacgatgttcgctgaatttgaacatctgattcatacaaaggcgcaagaaggcgagccgcttacacctgagcttctgacaaatgtctattacgacctgaataaaaagtattttggagacggcatggtgattgataaggaaatcggccttgaatggtcgcgtattccgcacttctattacaattactatgtgtatcagtatgcgacagggtacagcgctgcccaagcattaagcagccagattttgaaggaaggaaagccggcggttgaccgttatattgacttcctgaaagcgggaagctcacaatacccgattgatgtcctgaaaaaagcgggtgttgatatgacgtctccagagccaatcgaagccgcgtgcaaaatgtttgaagaaaaacttgatgaaatggaagagctgctgatgaaagtcaagcagtcttaaaaaagtaagcctgtgcggaaatgaagcacaggcttttttaaaaccctttaaaggttttccggtgattcaagcggtagagggtaaacaaaatagacagaaacagcagaggagaggtaatataaagcggcagcatatgcatcatgcctaagatattcagacagaaaaaaacggcaatgcacacaattgagatcaaagtagacatcatggcgatcctcctcgtcctttttccttataaggatatgagtgaatgcacttcgttatgttttgtgacaaaaatatgaacattaagcatagaggttgtcaaaagtcgacatcttttgttatcataaggatgtgaaattgatcacaaacaaacattacccctttgtttgaccgtgaaaaatttctcccatcccctttgttgtcgttaagacatatgaaaccgcgcttatcccggcgcggtttctttagtgctaaaaatggaacgtacgtttggttatggcataaaaaaacagcctcaagcatatgcacgcctgcggctatttttcacatgattgatattcatcagaataagtgctgagagacttccaaaacattccgtgtttggcttctactttggcaacctttttagcaaacgccagttttttcatttctttttctacctcttcaaggctcaggtcatatacaagagcaatttccttcgaggcaacgaagcggaaatattcaataaaacattctaaaggcggtgtttccgaaggcttcggctcgtcgccaagcatctcaaataaaatttcttcatatacatcatatgagtagctgccaggaactttaagcccttcatcctcatgctgcgtattaaaaaacgtcagtgtcggattaacagaaacatccatctcagcagcaattttcatgtcacattgaagcgccttgaccgcgctttgagaatgcagatcttttttgaattcttcaagatcgagacttgtattttcagcaatctccaaaagcacgttttcatccgtaatatttttctttgaaacaaataggctctcctgcatatttctgagaaattgcatgccggcttttcggccttgcaattcggctgctttaaaagcgagagcagccatataaggcgatgaaagcggctgatcctgttcgaaccagacattgccgtcacatgacatgccagagcggctcgcgatcttttcccatgcttctgcgagaagatgcttttttcgctttttatttaaagcggtaaggcttgcggaagcgataatgcgtaaggtgaaaaaacgtccgtatctgattttcagctttttgatgacgggctctaaggaccagcattcaggacataaagggtctacaaacatataaatttcaagcggtttttttggatgaccgtggcaatgggcgaagtatagctcatgctgatagtttgtcaagatgatcgatcctccgcttccgtttgattcaccatatgccttgctgtcaactccagccggccaaacaaaaactcacgaatttcgccctccagccctacatggtccattgcgtccttcatacagctgagccacgcatcagctctctcgtttgtaattggaaagggaagatgccttgctctgagcataggatggccgtgctcctcagtataaagcggaggcccgcctaaatactgagttaagaattgcttctgtttcctggcggtttctgtcaaatcgcttggaaaaatcggcttcagcaaaggatgagacgcgacacgctcataaaaagtatcaacaagttgcgatagaagttcctctccaatcgcttcataaggtgcgttaaacgattgtcccatgttgactactcctttaaatatggctaataggaatcataaatcctattgcaaaaagtaattttctgtatttcattgtttcatctagatttattttagcaacaaggcatcatttctacaaacaaactgccttttatgcgtttgatgactcatttcggctgacagccggggtttgtatttcatatcatatcacataaaaatcaggaatgcgtaagatttcacttcgcaaaaaaaccagagggaaagagcacctctggttacgcgtaataagctgaagttattttttttacatagttttgcgtttcttggaaaggaggaatgcctccgtatcggtcaacattccccggtccggcgttgtaagccgctaatgccatagacacattgccgtcgtatttatccagcatttgttttaaatatttcgttccgccctccacattttgctgcggatcaagcggattggaaacgccaagtgagcttgctgttgacggcatcagctgcatgaggcccatcgcacctgctccgctgaccgcttttgcattaaagcctgattcctgtttgatgacggcgcggatcagtttttcatcaacgccatatttatcagcggcttttttaatcgcactgtcaatagaaaagtctcccgaactgatctgatttgcttcatgtttgtttgaagctgaatctgcagcagatgtttcagtgctttctgccgcttttgtgattgaacctgaattgctgctcgtatatgagttaagcccatacgctgaaagcagtgacggcgctgttgtattcgcgctgttcagcatgctgagcgggcttggcgatgaagaaggtgctgattgctgagatgtcagaccgtttgtatattggctgagcaaagaactgaaacttgaaagcgggctttccgtattctgagtgtccgtgctgctgcgtgcattagatatggactgtaatgcctgaagctgaagtaatgctgcccaattcgttacattcacgatgtcattccaccttatatagactttcgtttttcttcataaaaacgcagaattttatttttggtttcgcgctgaggaatgctgaattgctgaagcagcttttcgaaggcttgtctgccctcatgccaatccgccgcctcaaattcaatttcatagtcctctttatttaaatatcggctgtggtctaaaactattaagcctttttctgtttctttttccgcacggtttgttgctaaagatccaaagtattgaatggcatccgtatcgatctgaagcttgtgcagctggtccttcacagggccctcgggaactgaaaatccagcgagatctgatacctctgaaagctgttggtgcgtttccagaagccccacatcagccggctcctttaatgtaaggacatactttccgttttttctgcggatacgaagcgcagcatgtttttgtttcagcgcgaagctgtctgtatcaaaataatgattcttttgatctgtaaaatctttttctgtcagctggagtgccgctgctatgtttttgaattcttgtttggtcagcatgtttttaaattcgatttcaatctcttggctcatgatgctcttcctttccgccctgtaaatcttatttttactattatctctttagatgttaggtttatcaatatcgagctcgatatgataaaatgaatctgtactttgtttaaaaaaggagagcattatgcaaaacagaatcgaaattttgaatgcaacattatcggatgatcagcttcgccttgtctgtcagacagaaggaaacgaagcggaacgcaagccgtcaggtcaaatgcttgttgattctgaccactttgcttttgtatacatacttgaattagctgattcttttgaatatgtcattataaaggaacatgtatggccggaactgaagcaggcccatgcacaaaaaataccggttgttttagaggcaggagaccaaacaattgaactggcaggcctgcataaggagctggaatatcttttagaaaatataaaagataatgcaaactatggagaagaaatggaagaaaaagtgaaacgcgtgtttttatagaaactggttcggaattgggggatgtatgatggatgacaaacaatgggagcgttttttagtgccgtaccgccaggctgtcgaagagttgaaagtgaagctcaaggggatccgcacactatatgaatacgaggacgaccattcaccgatcgaatttgtgaccggacgcgtcaagcctgtggcgagcatacttgaaaaagcgagacggaaaagcataccgctgcatgaaattgaaaccatgcaggacattgctggccttagaatcatgtgccaatttgtcgatgacatccaaatcgtaaaagagatgctttttgccagaaaagatttcaccgttgtggatcagagggattatattgcggaacataaagagagcggataccgatcataccatcttgttgtgctgtaccctttgcagacggtatccggagaaaagcatgttctcgtagaaatacagatccgtacactggcgatgaatttttgggcgaccattgaacattcattgaattataaatacagcggaaacattcctgaaaaagtaaaactaaggcttcagcgcgcttctgaagcggcttcccggcttgatgaagagatgtcggagatcaggggtgaagtacaggaagctcaagctgccttttcaagaaagaaaaaaggaagcgagcaacaataggtaaaggggaagaagagcatgaaatttgccgtatcatcaaaaggagatcaagtttctgatacgctgaaaagcaaaatacaggcgtatttattggattttgatatggaactggatgaaaatgaaccggaaatcgttatttcagtcggaggcgacggaacgcttttgtatgcttttcacagatacagcgaccgcttggacaaaacagcatttgtcggcgttcacacaggtcatctgggtttttatgcagactgggttcctcatgaaattgaaaaacttgttcttgccatcgcgaaaacgccgtatcatacagtcgaatatccgcttctcgaagtcattgtgacctatcacgaaaacgagcgggaagaaagatacttagctttgaatgaatgtacgattaaaagcatcgaaggaagccttgttgctgatgtggaaatcaaagggcagctctttgaaaccttccggggcgacggcctctgcctgtcaactccatcaggcagcacagcctacaataaggcgctgggcggagcgattatccatccgtctatcagggcgatccagcttgcggaaatggcttcaattaataaccgcgtgttccgtacggtcgggtcacctctgcttctcccatcccatcatgattgcatgattaagccgagaaacgaagttgactttcaagtgacgattgaccatttaacccttctccataaggatgtaaagtcgatccgctgccaagttgcatccgaaaaagtgcggtttgcgagattccgtccgtttccattttggaaaagagtccaggattcgtttattggaaaaggtgaatagaaagaggacatatcgtggagcatttttttatcagaaagaacattacttccgctgaggacgggatgactgtaaaggaatatgccagtgaactgggaatttcaaaacgtctgctgaccgatattaagtttggcgggggcgacctgcagattaacggtgagcatgtgacggtcaaatacgttttgaaagagggagatcttcttatcgtgaagtttcctgaggagcaggtgagcgagacgctgttggcagagcctgttccgctcgatatcctttatgaggatgaacatgtgcttgtgataaacaagcagccgtatgtgtcatcaatcccttcgagagagcacccctccggcagcattgccaatggaattattgatcattatcaaacaaccggagtgagggcgacagttcatcttgtcacccggttagaccgggatacatcaggtgtcatgcttgttgccaagcatcgatttgcccactccattttatcgtctgcgcaaaaaaacggccttgtgaaacgccggtatgcggcagtggttcacgggcggatggcacagatggagggaacagtcgatgctccgattggcagacatcctgacagtataattgaacggacggtaacgccagacggccagaaggctgttacgcatttttacgtcacatgtgcaaatgacgatatgacctcggtgacgttgcagcttgagactggacgaacccatcaaattcgtgttcatatgagttatctcgggcacccgttgtgcggcgatacactgtacggcggaacgagacaggaaattggccggcaggctctgcacagcgagcatctttcgtttatccatccgctgacacaggagaacatgacgtttcatgctccactgcctcaggatatgagaaaactgataaaaggagagaatcattgattctctccttttttatatggggcgaaatcttgattcgtcgtaaggcagggagcttggaacagagacggtttctatttctggaaaacgaaagcctgtcagttgatttccgaacacgcagcctgtatcaatgttgatggtgcgattgaccttccgaggctctttcacaggtgtatgaccgtataccacccaagcctttccgttataggctgccgcccaatcacgcctgatgggtctgccgtccggatatgtttcacccgtcacgtcaccgtaaagcacaaagtccttcactctgcgggtatatttgccgatatcgtcagctcttatgccagcatgggcgacaactaattctccattatgtaagatgtcgtaaagcggcgctgtttcgtacagcttcataaactgttcgctgactgattttttctcatctttggaaagttcctcaagctctgccgctgttgtttcgagaccatgcatcacttttaccggatttccttttaagtaacgatataatttattgcaatggtttcccgggacataacgtacagcgcctttttcgtaagcgccggctacaaatcggatgacctctatcgatttgggccctctgtcagttaaatctccggcaaaaacaagcaccctgccttcttcatggacaggtactccatttttgattgtatagccaagcttttggattaatgcagtcatttcgtcatagcagccatgaatatcgctgatgatatcgtaagccatgcggtctcctccttaccgattgttttatttattatgaagcaaagtgttgtgagtcatcacaagcttttatgtgcaaattatagaagaagaatcattttctaaacaggattaagaccttatcactttatttttcatcatcacccttgttaaaatcgcgttatgttttttaaaaatgaggttttgttctctgagtgagaactagcataaccctgacttaaaaaggaggttctgattatggcgcatacatctgtcgcatctttagttgttgtacttatcgttgcatttttgacacccatccttttgcatcggtttaaactcagcatcccggttgttgttgctgaaatcattatggggctgataattgggaaaagcggccttaatttagttgtggagggtgacacctggctccagacactctctatgctcggatttatctttttaatgtttttaagcgggcttgaaattgatttttcgtcgtttgagaaaggaaagaaaaagcagttcctgccgaatggcaaggaagcgccgaatacgtttgctgcggcatctgttattttcgtcggtatttttattttatcattgctcttgtcctatgggttcgtcttggccggatttatccaaaatgcatttttgatgaccctgattatttcaacgatttcattaggcgttgtcgttccaacattaaaagaagaacggatcatgaattcgaatatcgggcagattattttgcttgttgctgttattgctgatttggccacgatgattcttcttgctgttttttcttctttatacggagaggacagcggaaacatgtggctcctgatgattctgtttgcggccggagtggtgctttactttttcggccgggtcttcaaacatcgctcttttgttcaatccatgtcaaaagggacgatccagatcgggacgcgtgccatttttacgttaatcattgtactcgttgccctgtctgaatcacttggggcggaaaatattcttggcgctttcttagcgggggttctcgtttccctgctttcgccaaacaaagaacttgttcagcagctggattcatttggttatgggttcttaataccgattttctttgtgatggtcggtgtgaagctggatatttggactcttttccaggataaaacaattttaatcatgattccgctcctgctgctggcgctgttagtcagcaaaatcattcctgtcatgtacttaaagaagtggtatgataaccgaaccattttcgcgtctggtttcttgctgacatcaacgctttcgctcgtgattgccgctgcaacaatcgggcagcagcttcacgtgattagtgcaaatatgtcaggagcgctaattttagtagccgtcattgcaagtatttttacgccgatctgttttaaaaaattatacaaacgggaagagcagccggaggagaaaaagacgattacgttcattggcgccaatcaaatgactttgcctgtcacactcgaattgccagcggaagagtatgacgtgcgtgttgtacacgtctaccaagagaatgcggaggaaaagctgtcagaatcagtgtttgctgttgaaacaatttctgactatgaacacgagacgcttgaatcactcggcatttttgaaacggatatcctcgttgtggcgacaggaaatgaagatatgaatgcagacattgcattacttgcaaaagaaaaaggtacagaaagagtcattgcaagcgtaggatcaccggagcatgaagcagctctgaaggagcagggaatcagcatcttttctattctgctgtcgacaaaaacgctgcttcgcgcactgattgaagcgcctggcgtcatgaagctgctcacgaaccaagagtcttcgctgtatcaaattaatatggagaacagtaaatatgatggtgtcattttacgggaattccctttaacaggtgacgtcatctttgtcaggatcttcagaggtgtggacagcatcgttcctcatggggatacaaggctgaaacttggagaccgtttaattgtcaccggatctcgggggtacgtaacggatcttaagaaaacattggaaggataaatcttgaccaaataaggattcgtgttaatatagaggtgcagaacaattcaatatgtattcgtttaaccactaggggtgtccttcataagggctgagataaaagtgtgacttttagaccctcataacttgaacaggttcagacctgcgtagggaagtggagcggtatttgtgttattttactatgccaattccaaaccacttttccttgcgggaaagtggtttttttattttcagagggggaatgatttgtgaagttttcagaagaatgccgcagtgcagccgcagaatggtgggaggggagctttgtccatccgttcgttcaaggaatcggtgacggaacgcttccgattgaccgttttaaatactacgtacttcaggattcctattatttaacgcattttgcaaaggtgcagtcatttggcgccgcttatgcgaaggacctttatacaacggggcggatggcaagccatgcccaaggtacatatgaggcggaaatggcgcttcatcgggagtttgccgagctgttggaaatcagcgaggaagagcgtaaggcgtttaagccgtctcctactgcgtactcttacacatcccatatgtaccgttcggttttaagcgggaatttcgctgaaatcttagcggccctgctgccatgctattggctctattacgaggttggtgagaaattgctgcattgtgatccggggcatccaatttatcagaagtggattggcacatatggcggtgattggtttagacaacaggtcgaggagcaaatcaaccgctttgatgagctggcggaaaacagcacggaggaagtgcgtgccaagatgaaagagaattttgtcatctccagctactatgaatatcaattttggggaatggcctatcgaaaagaaggctggtctgacagcgccataaaagaggtggaggaatgtggagcttcacgccataacggatgacagcaagccggtagaagagctagcgagaatcatcattacgattcagaatgaagttgattttattcacattcgggaacgctcaaaatcggcggcggatattttgaaactgctcgatcttatttttgaaggcggtatagataaacgaaaactggtgatgaacgggcgcgtggatattgcacttttctctactattcaccgcgtgcagctgccaagcggcagcttttcaccgaagcaggtcagagccagatttccacaccttcatatcgggaggtcggtgcattcactggaggaagcggttcaagcagaaaaggaagacgcggactacgtgctgttcggccatgtgtttgaaacggattgcaaaaagggtcttgaaggcagaggagtatctttgctgtcagatatcaaacagcggatttccatcccggttatagccatcggggggatgacgccggacaggttaagagacgtaaaacaagcaggggcagacggcattgctgttatgtcaggaattttctcttccgctgaacctttggaagcagccagacgatattcccgcaagctaaaggagatgcgctatgaaaaggcattatgaagcagtggtgattggaggcggaattatcggttccgcgattgcttattatttggcaaaggaaaacaaaagcaccgcattgtttgaaagcggaacaatgggcggcagaacgacaagtgccgctgccggaatgctgggcgcccatgccgaatgcgaggaacgtgacgcgttttttgatttcgccatgcacagccagcgtctgtacaaaggtcttggagaagagctttatgcattatccggtgtggatatcaggcagcataacggcggtatgtttaagcttgcattttctgaagaagatgtgctgcagctgagacagatggacgatttggactctgtcagctggtattcaaaagaagaggtgttagaaaaagagccgtatgcgtctggtgacatctttggtgcatcttttattcaggatgatgtgcatgtggagccttattttgtttgcaaggcatatgtgaaagcagcaaaaatgcttggggcggagatttttgagcatacgcccgtcctgcatgtcgaacgtgacggtgaagccctgttcatcaagacccctagcggagacgtatgggctaatcatgttgtcgttgccagcggggtgtggagcggaatgttttttaaacagcttggactgaacaatgcttttctccctgtaaaaggggagtgcctgtccgtttggaatgatgatatcccgctgacaaaaacgctttaccatgatcactgctatatcgtaccgagaaaaagcggaagactggttgtcggcgcgacaatgaagccgggggactggagtgaaacaccggatcttggcggattggaatccgttatgaaaaaagcaaaaacgatgctgccggctatacagaatatgaaggtggatcgtttttgggcgggactccggccgggaacaaaggatggaaaaccgtacatcggcagacatcctgaggacagccgtattttatttgcggctggccatttcagaaacgggatcctgcttgctcccgcaacgggcgctttgatcagtgatctcatcatgaataaagaggtcaaccaagactggctgcacgcattccgaattgatcgcaaggaggcggttcagatatgatgctacagctgaacggtaaagacgtgaagtgggaaaaagacacaggtacaattcaagacctgctggcgtcgtatcagcttgaaaataaaatcgttatcgtggaaagaaataaagaaataatcgggaaagaacgctatcacgaggttgagctttgtgatcgtgatgtcattgaaattgtccattttgtaggaggcggatgagcatgttaacaattggcggaaaatcatttcaatcaagattgctgctgggcacggggaaatacccatcgtttgacattcaaaaggaagcagtagctgtttctgagtctgatattttaacatttgctgtaaggagaatgaacatctttgaagcatctcagccaaattttctggaacagcttgatttatccaaatatacgcttttgccgaatacagcgggcgccagcactgctgaagaagcggttcggattgcaaggctggcgaaagcgtcaggcctttgtgacatgattaaagttgaagtcatcggatgcagccgttccttgctgcctgaccctgttgagacattaaaagcgtctgaacagcttcttgaagaaggctttattgtgctcccgtacacgtcggatgacgttgtgctggcgagaaagctggaagagctcggcgttcatgccatcatgccgggtgcatctccgattggatcaggacaaggaatcttaaatcctttgaatctgtcatttattattgaacaggcgaaagtgccggtcatcgtggatgcgggaatcggctcgcctaaagatgcggcatacgcaatggagcttggagcggatggcgtactgctcaatacggctgtatctggcgctgacgatcccgtgaaaatggctcgtgccatgaagctcgcagtggaagcagggcgcctttcttatgaggcgggccgaatcccgcttaagcaatacggaacggcaagcagtccgggagaaggtcttcctgtatgacaggcaggtattcaaggcaggagctgtttgctccgatcggcccatccggccagaaaaaattgaaagaagcgcgcgccgtgattatcggcgccggcgcgctcggaacagccagtgcagaaatgctggtgagagcgggagtcggctctgtgaaaattgccgacagagattatgttgaatggagcaacctccagcgccagcagctttatacagaagatgatgtcaaaaaagaaatgccgaaagcagccgctgcggagcgccgtctccgttcgattaacagcgatgttgatgtgaccggacttgtcatggatgtgacagcagaaaatatcttcgagctgattagggatgcatcgattattgtggatgcggctgataattttgaaacccgcctgatcgtaaatgatgctgcggtaaaggaagggattccttttctttacggtgcctgtgtagggagctacggcctcacctttaccgtggtgccgggttctactccttgcctgcattgcttgctcgatacacttccgattggcggagcaacatgtgacacagccggcatcatcagtccggctgttttgcaggtagcagtctttcaggtaacagatgcactgaagctgctgacgggagaggagtgcgagccggtgctgcgctcctttgatttgtggaaaaatgagcggtcagaagtgagagcggccagtctcaaacatgacgcatgcccaagctgcggcacaaaggattttccgtttttgtcatatgaaaatcaaacaaaagcggctgtattgtgcggcaggaacacggtgcagatcagatcatctattacgaaagaagcggagcttgaagcgcttgccggtcagctgaggcaggccgggcttgaagtagctgcgaacccgtatttaatttcctgccgctcggatgatatgaaaatggtgctgttccgggacggcagagctttgatccatggaacaaatgatattgcccgggcaaaatccatttatcataaatggatcgggtaataaaaggagtgtagtgtaatgagtatatataaagcattgacaatcgccggatcagattcaggcggcggcgcagggatacaggctgatattaaaacctttcaagagcttgatgtattcgggatgtctgcgattacagcggtaaccgctcaaaatacgcttggcgttcatggggtgcatccgctgactgtagaggcgttgagacagcaaattgacgctgttgctgaggatttgagaccggatgcagtcaaaacgggaatgctctggaatgccgacatgattgaagaagtggcaagaaaaattgacgagtacggattcaatcgtgtaattgttgatccggttatgatcgcaaagggcggggcatccttgctgcgtgatgagtcagttgccaccttaaaggagttgctcattccaagaagctacgcgattacgccgaatgtcccggaagcagaaacgctgacaggaatgacaatcagctcgctggatgaccggaaaaaagcagcagagcagctcgtcaagatgggtgcgcagcatgtcattatcaaaggcgggcaccagcctgaggacaatcacattactgaccttctttttgatggcagcatgtttatgcaaatcacccatccttatatcaatacgaagcatacgcatggcacaggctgcacctttgctgcggctttaacggcccaaacggctaaaggagacagcatccatcaggcatttgaggttgcggccaactttgtccgcgaagcggtggaaaatacgctcggcatcggatcgggacacgggccgacaaaccatttcgcttttaaacgaaacagcttaaatacaagccgatgagatcaccagctgatggtgatctcttttgcgtttgctacggtatgcgcttttcatctggacaaggttatgatatgataggaattaagatcaggtactaatactatgtctttattaaatataggaggctttatacatatgaatttttcacttgaaggccgcaacattgttgtgatgggggtagccaacaaacgcagcatcgcctggggcattgcgcgttctttacatgaagcgggtgcacgtttgattttcacatatgcaggcgaacgcttggagaaatctgttcatgagcttgccggaacgttagaccgcaacgattccatcatccttccttgcgatgtaacaaacgacgcagaaatcgaaacttgcttcgcaagcattaaggagcaggtcggtgtaatccacggtatcgcgcattgtatcgcgtttgccaacaaagaagagcttgtcggcgaatacttaaacacaaatcgtgacggcttccttttggctcataacatcagctcatattctctgactgctgttgtcaaagcggcacgtccgatgatgactgaaggcggaagcattgtcactttgacgtaccttggcggagagcttgtgatgccaaactacaacgttatgggtgtagcaaaagcttctcttgatgcaagtgtgaaatatttagctgctgacttaggaaaagaaaatatccgcgtcaacagcatttctgccggcccgatcagaacattatctgctaaaggcatcagcgatttcaactctatcttaaaagacatcgaagagcgtgcaccgcttcgccgcacgacaacacctgaagaagtgggcgatacagctgcgttcttgttcagcgatatgtcccgcgggattacaggtgaaaatcttcacgttgattcaggtttccatatcactgcccgctaagcaggatctatatcaagcaatcccgaatagggattgcttttttatttcttctgattttcagctttctgtcatatagatagaatatgacacaatcggagggatgaagatgtctaataagaaaagaaacgcggataaaaaaccgctcatgtatattgttcagccggattatgcagaaactacaaggtcatccatgcaggagattgtcatcaaaagaaaggccgacaaacctgctccgccaaaagctgaggaaaagccggcttatcatgagaagcagcaggaggaagccgtggcacaggatgtcctgcaagaagaccaaaagcctgcagccgaaccagtgagtcagcaaacacaagaggcgagagagccagagaacataaaaagccaagaggaacagagagcagagccgcaggccgtagaagaaaccgttgaacacgagcccccgaaagcagaaaaaaaggaagagcctgcacttgaggcccggaagcctgagaaagaaccggaagctgtccatagtgccgataaagcggaggaaaaagcacctccggcacgaaaagtgaaaaaaccgatgagcaagatgacgatccacgaaaaaattgattttttaacaaagctgcctcataacatgccgagagcgctttgtttgattgaagccaatggaagaacgtacaggggcgtaattgtcggaagaagaaatgattccgtcctgcttcgaacaacaggaaacggagccccaaccgaactggcaatcgatgatattacctctttgcacccgctcggtttttaacgaaaaagaaaaaagctgcccggctgatgttgccggacagcttttttacatagagaaaagcctgcaggcctgcaagcttttccagcttatgattaatgatgatgtgtacgattgattaatcgaggatttaagcagttgattgcgcagaagcagtctaagtcaacttcaatacagtagttcgttttttcgagtcggaacacttcacacaccgtatctttatcggtgaagtccaaaatgtgtttgtgttcgtcaaatgcgattaataatgacagtgttgcgcagcttccatgcactctttcaaccctgaaaaatactgtattaaagcaagggccgttatcgagttcgccgacatttccgaaggcgactaatggcgttgattttgatgtaaatattgcaaaaggcactgtgtcgcctaacgaatggcttacagataaaagcttagagtggcagccggtcgggcagtcttcttcaacagcgttttgcagatcttcaatattttctacagcttcacgcacgcagcttgatgttttctggctcatattatccctcctgccttataaatttgagactggcgaaatgatggagagtcagctgcctcacgctggaagcagctgaatgatttgcacctgtaatagagtttggaaggggattcctctttacaagtgtttatccattgtgatgatgctttttatctttatgaggcgatgttctgtcaactagctctggtgacaggcactgaatcgcgcagaagcatccgagatcgacttcaatgcagaaatctgttttttctagcccgaagaaatccgggtcgcaagggtggcaaacacttaaggtatcgcctttgacatcgaccgggcgtaaaatagaaagtgttgcacagcaatcgcataatttttcgacgcggaagaaaatggattcaaagcattgcatatcatccacaaatccccccacgtttccgaatgtggagaacaatccgccttttttatcaaaaacgagaaacggaattgtgtcttttccagcaatcgtagggtttaaaaggttggtatagcagccagtcggacactgttcttcaactgcctcctgctctgctaaaatcttttccactgcatcgcatacacagttctcatgccggccatgggtttttccgcagctcattgatttcagctccttctttatagggtatttgactttagtccttaacaacatatgtacccgtgccccacttggtgtgggtgaacgtctatatattcatcatatgcttggaaaataagaaaaagcagagcgtttttagctctgcttttagatattagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacattttcttggacagacataaccttcactcctttcttatccatactctatataatgcaaatggggtgcagagcggaataataaaaataaccaattttctgccggacaagatacaattcatgaagaatagggttttggcatatatgtgaagggatcatgattggcaaaggagtgaacgagtggttataaatgggctgacaattgttcttctatcgcttgcggtctttcggctcgcccgcctgctggtgtttgacacgattatggcgccgcttcgcagtctgtttcatgaagagaaggaagaaaaggatgcggacgggaacattgaaacctatatcgtgattaagggaaccggtgtcagggcgtttattggtgaattgctgagctgctattggtgcacaggcgtgtggtgcgccggctttttgattttatgccaggcgttgatcccgcaagcggcgcagtggctgattttacttttggcgatcgccggccttgccggcatcatagaaacgctcgtatcaaaatggctgcaagaataaggcgttactaccagcaactttctgtcagaatacgcataaagtagcatatatgacataaggaaaggaaggggacaaaaatgaatcagcatcataaaccttcccaaaaatctccatatacagattcatcgtatcaatcaaaaaagataaaaaagaaaggctgcgggtgcggaaataaaaagaaaaagcctcaatagcctggcaaagaaaccggagaactccggttttttgtttttttaacggggcggccttgctcagcatatatcataagcggggggataaaagtgaatgagtttgaaaaatggatagaaggaagatatgaaccacacgaacaaaagcaaaaaagcatgaagacacgatgggcagtatcagaaaagacttggatgcatttgataaagccggtctggaatttgaagatgagattgaagagctggctgaaaaaacagaggccttacttaaaaaacatcaagctcaatatgatcaatcgtaaatccgcaaacgccctatgcgaatatccaagccgatcccagcagctcacatagtgtatagagagtaaaggaggtgcttatctatgggctttggatacggattcggcggcggctacggcggcggctgttatggcggttatgctggcggttacggcggcggctatggttcaacatttgttttgttggtcgtattattcattctcctcatcatcgtaggtgcatctttcttttaagatgtattgaggaagtacgggttataacccgtgcttccttgccttgtgtttatttttaaaaatgttggaaaagcacattgtattatgtgcattcatacaataccgtattactccgccaaaaggaggcgcattatggataatcaattttttaagaacatcgaaaagaaaacaggtgtgaagatgcaggatgtaatgaatcttgccggatcactccaaaacgctaattttaaagatgaaaatacagtccgcagtgtgattaaccgcgtagcgcagctggcaaacagacgcgtgccaaaagaattagaagataaaattgtggaatctattacaagcggaaaagaaaagcttgattttggcacgatttctaaaatgatggataataaataagtggatggcctggctgactcactgcagcgggcctttttttacagtaaaaacccggcagtaatctgccgggctgttaatgatgcaagggctgtcttgctttctgtagcaggggatacaaaaatcttgagcggttggctgttttgccgcgcctgttagcggggcaagacaaatataaatgctgtttcgcccgggtcatggctacatataaaaggcgtctttcctcctcaagagcggcctcgtctccttttcttgccgtttctaatgagaaatcgtgcggaatcgaaccgtctacagtgcctaacacgtagactgttttgaattcaaggccttttgaccggtgaatggtcatcagctgaacgccatgttcatccgttctgtttttctcagcggccctcatatggtctacgtgggcaagaaagtcaggaatcgttttgaacttcttggcgacaaccttgatatcgcgcaggtcatcggaacctttttccagcttgttgccctcattgccccgcttttttaaatactcggagaagcccatttttccttctgcaaaggtgatggcttctacgggcttcatcgtgcggaggcttgcaaaaaacggtacgattttcttgattttgtccagctggaatggcttcagatcaggcaatttggccagcgctttgatcatggtacagtcctctgtgatcgagagcgccttcagcgtattcaaagcggactgttttaaaaacaaggcgggaagcaagtgtttaatcgcttcggtatcatcctcattttggctggcgtacaagtaggcgagaatctggcggacgatccgtctgctgtaaaacgattggacgccgcggtcagctgtatacggaattgacgattgatgaagcctttcatatatagcacggcctccgctgtttgtgcggtaaagaaccgcaaagtcttctggactggctccattttgaattttttctttgatatcggaaacgaccattgtggcttcttcctcttcatcataaggataaaacagcacagggacctgaatgtcatcgcgggccgcttcaagcgttttggcatatctgtttttgttctttttcacaacgatatcagcactagagacgatcgggtgcgtagacctgtagttcgcagttaaatagatcgtcttcgctcccggataatccttttgaaaatcaagaatgaaagacggattgcttccgcgaaacgcgtagatggactggtcatcgtctccgacacagcacaggttttgctccgggctggcgagcatttgcatgattttgtattgaaccggattaatgtcctgaaactcatcaattaagatatacgtaaaccgagattgatattgttccagaaggtcaggccgctcgataaacaattcatagcaggctgaagccatgtcatcaaaatcaaattggctgtgttcttttttctggcgttcataatgttcatataaacgataaacttgtttttcccactcatcttttagagggatgcgttcatttgggacataagtgtttttccaaaaaccgatctgctgcagagcttggtcaactgggaattctttctcatcgatgccttcttcatagagtgcttttttgatatattgttcccgctgccactccattttcagcagatgctcaccgttccatttagcagaattagagtgatacaagatcttataaaacagactgtggaatgttcctgtcacaagtcttctgacttttgccggctgtaatccgtactggttcgccatacgctctttcatttcagcgactgcttttgttgtaaaggtgacaagcagcatattttcaggcggtatgcctaagtgttcgatcatgtgggcggcacgggctgtcagcacccgtgtttttccgctccccgcacctgcaagcacgaggagcgggccctctgtttccgtgacagctttcagctgatccgtgtttaaaccgacagacggaaaaaggctcgtatcgggttctattgtttttggcacaaatggtgttcctggtttaatgcttctaggacggtgccattccgtaacagctggggacgggtcagcggcgatcgcttttcccttgggtaaacgaatgacaccagattcctgatcatcttcttttttcccctctttagagggcttcggttcgcacgcctcctcacatgccggaaaatcgcctggctggcgatggataaactctggcggatcggcgatgttaagccgtaacaaaacgggctttccgcaatgagaacaaaataaatgtccttttattccctcttcaaagaggaattgataatgttctctcgaatatgtatgtaaatgtatgattctatcatttagtcgggcgcatttcaaaaaggggtcctcccaatcaaaaggtgttcattacagacaatgactatcatatcaaaagaaatgtgtttcaaaaagtaagtttaagggaaaagagacagcagaggggtgggtattgtatgatatatgcaggtcaaattcagaaccagcaatacgctcaatatgctaatagaacgattggacataagcaggattatgccggaaccgaaaaaatcagctatgtcccgtttcagcgggtatacaaagaactggaaaagcagcaggagaatcaaacggcagctgaaagaaaagtaaacgagatgaaacgtaagcgctctctttataagagattgcgagaaaaaggaatgggcacatatattaatcgatatgtataaaaaaccgttcataccagagaacggttttttatatgcagaaaaaatccggatctcaaaagatccggatgcgttcagtccttcatcatttgtaagtgcggaatgccggcatcgaggaattctttttcagaaagcacgcgatacccgtgtttcttgtaaaacggcacagcctgtgtttgcgcgtttaaaatgaaaccggaagcgcctccgtctgccgcggctttttcgagcgctttcataatgatgccgccgacaccggctgagcggtggcttttcagtacgcaaatccgctctaacttgccgtagccgtccttcatgcgccatcttccggcgccgacaggcttttcaccgtcatacacgacgatatgctctgactcattttcaagttcgtcaatttcttcttcagcaggcacgttttgttctttgacaaagacttcttctcttacatagaatgcatctttcagttgttcttcattttttgcgataactgctttcaaacattattctcctctgcctagcaagaaggtttcatatactgtccacgatccgttttccagctggtaaagcaagtggaaacggtcaacgatttcttcatgcgacacttcctgcatttttaattgtcccagcacatctgaatgctcatcgtcggagagattttggccgaccgtcacatgcggaacgaaattatattcctgttctcctgccaacacaccggtgtatagcttttcattgagtgtttttaactcttccgtcggttctgctttgatgtaaatgacattattgacaggcgcaaatgagctgtattttgtcattttgagaacgagtgggtgggactcttttgcgatgtttcttaaatgtgatacgagctgatccgctttctcctccgcgcattcaaaggatgctctcagcgtcaaatgaggcgggatcagagagtagcttgggtcatagcgctttctgtaagagtttgcaaggtcttggagcttttttgatggaaataaaacgattccgtatttcatattatgtccctcctggaaataaagtatgatagagtgttaaagcatttttttcagcgccggggtgatgagcggctgccagtatgtccatttgtggtctccgtcaaatggctcgaaatcataatcggaaagctttttctccagcagctgtttcagctcccggttcggttctgtaaagtccagaatgttcccgtctgtcgtgtggacgtcagtttcttttgttccgatttggtgataaatagagaggtgtttgatatcgtctgactgttttacggcttctagtacgtgtttgtcaacatagggagactgcatgatgatgttgccaaacatattcggataatcaagcgctgtcataagtgacacggttgctccgagcgaatcaccgatcagcgttcggccgtaaccgatctgataggttggatactcatcatctgcaaaaggaacgagctcatgggcgatgaaccgtttataagccgaaaattttgaaccctccggatgataggtgtttctgcgctcttttacatccttataaggaacaccgataataatgctccggtctatttcgcgtttcgacagcaattcctcaacctgtctgccgattctccccagcctgaaataatcgtggccgtcctgcgcgataatgacatggtatttataaagcggggagtagttggacggcagataaacaagcaaggtcatttcctcgttaagctcttttgaaaagaatttcttttcttgcactgtgccgtttttcggtgccataaaaacattcctccaggacatcactatactttcttgcattttcaattattgtaccatgaattattagaaatttctctctttaaacggttcggcacacgaagaaaaaagtgttgaaataaactgtgaattgcgctaatataaaataatcagaaaattgaaatcaatatttcttatcgtgagaggtggagggactggcccttagaaacctcagcaaccggcttgttttgcatgtgcaaagcgccaaggtgctaaatccagcaagcgttttttatgcttggaagataagaagaagcgttaaaccccttcttcttatgaagaaggggtttttattttgaaaagggaaggtgtcagctatatgtcacagcacgttgaaacgaaattagctcaaattgggaaccgtagcgatgaagtcacgggaacagtgagtgctcctatctatttatcaacagcataccgccacagagggatcggagaatctaccggatttgattatgtccgcacaaaaaatccgacacgccagcttgttgaggacgcgatcgctaacttagaaaacggcgcgagagggcttgcctttagttcgggaatggctgctatccaaacgattatggcgctgtttaaaagcggagatgaactgatcgtttcatcggacctatatggcggcacgtaccgtttatttgaaaatgaatggaaaaaatacggattgacttttcattatgatgatttcagcgatgaggactgtttacgctctaagattacgccgaatacaaaagcggtgtttgtggaaacgccgacaaaccccctcatgcaggaggcggacattgaacatattgcccggattacaaaggagcacggtcttctgctgattgtagataatacattttatacaccggtcttgcagcggccgcttgagctgggagctgacattgtcattcacagcgcaaccaagtatttaggcgggcataacgatctgcttgctggacttgtcgtggtgaaggatgagcggctcggagaggaaatgtttcagcatcaaaatgcaatcggcgccgtcctgccgccatttgattcgtggcttctgatgagaggaatgaagacgctgagcctcagaatgcgtcagcatcaggcaaacgcgcaggagcttgcggcgtttttagaagagcaggaagaaatttcggatgtgctgtatcccggaaaaggcggcatgctgtccttccgtctgcaaaaagaagaatgggtcaatccgtttttaaaagcactgaagaccatttgttttgcagaaagcctcggcggggtggaaagctttattacataccctgcgacccagacgcacatggatattcctgaagagatccgcatcgcaaacggggtgtgcaatcggttgctgcgcttttctgtcggtattgaacatgcggaagatttaaaagaggatctaaaacaggcattatgtcaggtcaaagagggagctgtttcttttgagtaaacacaattggacgctggaaacccagctcgtgcacaatccatttaaaacagacggcggaaccggggcggtcagtgtaccgattcagcacgcctcgacttttcaccaatcttcatttgaagagttcggggcatatgattacagccgctctggcacgccgacaagaacagctctcgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaatacaaaggtcatttatatggagacgccatcaaatccgacacttgggattacggatattaaagcgattgttcagcttgcaaaagaaaacggctgtctgacctttctggacaatacattcatgacaccggcactgcagcgtccgcttgacctcggcgtggatattgtacttcacagcgcgacaaaattcttaagcggacacagcgatgtgctctcaggtttggctgctgtcaaagatgaagagcttgggaagcagctgtataagctgcaaaacgcgttcggcgccgtccttggcgtacaggattgctggcttgtcctgcgcggattaaaaacattgcaggtccgtttagagaaggcgagtcaaacagcccagcggcttgcggaatttttccagaagcatccggcggtgaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactcccagtcttcgctgtcagccttggcgccgtggaatcgattttgtcctatccggcaacgatgtctcatgcggcaatgcctaaggaagagcgtgaaaaacgcggtatcactgatggcctgctccgtctgagtgtcggcgtcgaacatgcagacgatttagaacacgatttcgaacaagcgctgaaagaaattgctccagttgcggttcgttaaaaaagaagccggggatggcccggcttcttttattattgttcgtcatcaggattcagaatcgcaaggacttgatgatcctcccaaacgccattaatttttacattttttcgggcgatgccttctttatgaaatcccgctttttctaaaacacgcatggacccgagattacggggcatcacaccggcttcaatccgatgcagtttcaattcgtggaacgcataatcaacaaccaatctgactgcctctgtcataatatcctttccattatgggctttgtctaaaaaatacccaatgaacgcagtttgcagcgctccacggatgatttgaaagagcgaaaccgtcccgattaatctatcgtctgacgctgtaaagatgccaaaatgatattcttcatctttctcaagtctttcctgatactcggttattcgttttctttgcccctcaatcgtataataatcgtctgcgcgtatcatagaaaactgttcgaagaaatctcgattttcactttgcagccgcagattttcttcggcatccgttacttctaaaggtctaacataaatggtttttccttttaacatacagtgatctctccgttctcatgtcagcattcctcttacattattctcagggaaatgcaaatatcctttttataagaaggaagaaaaccaatttcccataaaagtgccaacatagttgccgattaagtagccgagcgtaccgacaagcatgatcggggcgacaagctcccgccatcccttggcaattgccatcgcagccgcagtcgtcggtcccccgacagtagcgttgacggcgagcagaatttcttcaagccgcacgcggaacaattttccggcagctaaggaaactgctaaattgctgatcgcaatgataaacacgaataatagaataagaggcgcattcgtgacgattaagcggagatctgcaggaatgccgatcaccacaaaaaacaaataaatcaaaaaggttccaagttcctgagatccattgagcctttcaaaaaaacgcgggaaaagaaaaatgataagaacagttaaagacgtaagcaccaggtactgatcgccaagcgtaccggtcagcaggggatgagaaaaaatgcttttaaaataaccggaaaccttcatactaaccgcaacaagtgcgaaagcggcaccggcattaaatgcgatatcctttaaggaaatatccttccgtttccaatagctttcagcactgtttccgctgtttccatcggcttttaccttctcttcaaacggcatggcataatgccgctgaaaccatttgagtgcaggaatgctgattaaaataaaaaacaaaagcgccatcataaaattatcagccacaacggtagccgacacatattcaccaggcgtctcaaattttgccgccatcgccgcaaagttgaccccgccgccgatataagaggcgctgatcatcccgccgattttatctaagtaaggaatatgctgtttaagtagaaaaaaagcaagaatgctcccaagcacagtgccagcggagctaatcagaaaaataaacagcaaacgcctgctttccttaaaaatttgccgaacattgatctgaaacagcaaaaggggaatcgcaagcggcaccacataagcccacacagtatcatacacaggcgactcaacaggaagcactcctacatttgtaaacaccatagcacctgccagcgcgataatagcacccgacacagcggacgcccacttaaagcgctgctccagcccgatgctcactgccgcccacaccgcaataaacccccacaatacccatgcgtcatcagaagaaatcaaagaatgcaaaaccccatcacctctattgttagaaaattaagacatattataatagccggggaacggaacagcaagtccaagaaaagtttttctaaaaaagcagttgacgaatagaagggaaggttatataatagaacttgtcagaaagacaacaacatacccagcaacacatacatatcatgattccgtagctcagctgggagagcgctaccttgacagggtagaggtcgctggttcgagcccagtcggaatcatagcttaaacccttgcgcagcaagggttttttactttgcttaataaagcggtttatcaaattcggatttgttggcaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaaaaaaatgaaaaagaaaacctcatttatactttcaattttggcagcacttatagttatattgattgcactaccggttctatctcctgttgtttttacaggtgcttctgaaaaaggagcaatcagacacgaaatttataaaagaggatatccctaccaaagctactttgcagtactccataaagaaggtgacaatgaatctgggaatctttattatgtgaattggctagattggaaagataaaactggacaaacgcctcacttatgctattcaaaaaaatcatcagatggtaaatacaaagtagactgtggaaccggggcgtaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagcatccttcggggtgcttttttatattctttgtaaactgcttccggtaaatctcaggatagactattggcggttaacagcttgagtgcggtggcagtttagaaagaatatctttttcaaaacaacacgaatcagaaggaggcggcagtgaatgtagatggtagaaaagcatattcaggcatataaggattacgtcaaaggaatgaaatacaaggacctttccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtttgtcacttgttttagtgtgtggtttcggatccttaacagaaaatcaaactcaaaacacatttcatattgcctctgatcgttttcaaacttgataatattacattcaacctccttcagaaatggaggtttttttatttgatatcaannnnnnnnnnnnnnnnnnnnnnnnnnnnnnnnnnnnnnnnnnnnnnnnnnnnnnnnnnnnnnntttttcaagaaaatgttataatgaaaagccataaaatgatgggaggggaaatttcgatgcattacataacggcatgtttaaaaatcatcagtgataaagaccttaatgagataatgaaggaattcaaaaaacttgaggaagaaacgaacaaagaagaaggttgtattacattccatgcttatccgcttgagccatcagaacgtaaaataatgctttgggagatttgggaaaacgaagaagctgtgaaaacccatttcaggaaaaaacacacaatagacgttcaaaaacaagaattaacggaagtagaatggttaatggaaagcaatgtgaatgattaataaggcatcttcaaacgagacattcaaaaactaagaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacttccttagcagatgctacaccactaactgacaaagctaaagcagaaatcgataaagcagaaacagctgttttcttgaaattcattttaaacactccttttgaatttttgtgttacaccataaggattcaacgaaagtaattattttccttgtaaataaatgttaattatttatgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaatcgtatttttccggatgtttcggtaaaaaacgaaacttttgtctctatgattttattttataatgtaaacggtttcttatatagtatacttatactatcaatttgctcaagtagatactgacaggaaggatagaaaaacagatggaatacataaatacaagacaaaaagagattttgtatctgttgttatctgaacctgatgactatttagttgtgcaagatttcgcagatagggtacagtgttctgaaaaaacaatccggaatgatttgaaagtgatcgaggattatctcaatgagcattctcatgcacagcttattcgaaaaccagggttgggcgtttatttacatatagaagaacaggaaaggacctggctaagccaacaattacatactgaacatttttcttctaggcagcggagcgatgaagaaagaatgctgcacattgcttatgacttattaatgaatccgaagcctgtttccgcaaaagacattgccgctcggcattttgtcaatcgatcttccattaaaaaggatttatacgcagtagaagagtggctgaagcgttttgatctcacactggtttctaggcagcggcttggattaaaggttgaagggaacgaaagaaataaaagaaaggcattggcaagaatatctgatttgatccacaatacagcgtttaccagccaatttattaaaagtaagtttttacattatgaagtagactttgtgacgaaagaaatcaaatcactacaaaaaaagcattccctctatttcacagacgaaacgtttgaaagtttgctgctgcatacattgttaatggtccgccgcatcaaaatgaagcagccgatttcattgtccccaaaagaaatggcggcagtaaaaaagaagaaagaatatcaatggacatttgcttgtttacaacggctcgaaccggtttttgcaatccgcttccctgaagaagaagccgtgtacttaacattacatatattgggcggtaaagttcgttatccattgcagacagaagagaaccttgaaaatgctgtgcttcctaaggttgtagggcatttaatcaatcgtgtttcagagctgaaaatgatggattttcataaggatcaggatttgatcaatggtttgaacattcatctcaatactgtgctacaacggctgagctacgatctttctgtagcaaatcctatgctcaatgacatcaaaaagatgtacccttatttgttccacctcatcattgatgttttggaagacatcaatcatacttttgatcttcaaattcctgaggaagaggcagcatatttgacattgcattttcaggcagcgatcgaacggatgcagtgcagcagcgagacacataaaaaggcgattatcgtctgccacatggggattgggatgtcacaattgctgcggacaaaaattgaacggaaatgtcatcaaatcgctgtaatggcctgtattgcaaaggccgatttaaaggattatatcaaaaagcatgaggatattgatcttgtcatatccaccattgcgctggagaatataacggttccccatattgttgtatctccgcttttagagcctggcgaagagaagaaattaagtgcgtttatacgtcagctgggcgaatcacaccgccaaaaacaaaaaacgtttcagatgctgaacaatacgactccttttttggtttttttgcagcaggaggcagagcaccgctacaagttaatcgaacagctggcgacagctttgtttgagaaaggctatgttgataaggactatgcggttcatgtggtgatgagggaaaaaatgtcggcgacaaatattggatcaggcattgccattcctcatgcaaacgctaaatttattaaacaatcagcaatcgcgattgccacattaaaggagccgcttgaatggggaaatgaaaaagtttcgctcgtttttatgctggctgtcaaacacgaggatcaaaccatgacaaagcagctgtttagcgagctttcatatcttagcgagcagccggccttcgtccagaagctgacgaaagaagccaatgtcatgacatttttatctcatttggattattaaagcagggattattccttgcttttttttgttatagggaaaaatgcctttattaccggaacctatggtaaaaaaaagcgattttaatgagctgatttcagtatacagttgagacaagatcttattattcacactttaaaggaggtttcctatgaaactgttagcgattacatcttgtccgaatggaatcgcccatacgtatatggcagcggaaaatctgcaaaaagctgctgacagactgggcgttagcatcaaagttgagacccaggggggaattggtgtcgaaaataagctaaccgaagaggaaattcgcgaagcggacgcaatcattattgctgcagaccgctcggtaaacaaagaccggtttataggcaaaaaactgctgtctgtgggggtacaggacggcatccgcaaaccggaagaattgattcaaaaagctcttaacggggatataccggtctatcgttccgctacaaaatcggagcccggtaatcatcaggagaagaaacaaaatccaatttaccgtcatttaatgaacggcgtttcatttatggttcctttcattgttgtcggcggattattgatagcggttgcattaacgcttggaggggagaaaacacctaaaggcttagttattccggatgattccttctggaaaacgattgaacagatcggcagtgcttcattttcatttatgattccgattttagccggctatatcgcctatagcatcgctgataaaccggggcttgtgccagggatgatcggcggttatattgcggcgactggaagtttttatgacagcgcaagcggcgccggattcctcggggggattattgccgggtttttggccggatacgcggcactttggatcaaaaaattaaaagttccaaaagccatccagccgattatgccgattattattattccggtgtttgcatcactgattgtaggtttagcgtttgtatttttgataggcgcgcctgtagctcaaattttcgcctctttaacagtttggctggcggggatgaaagggtcgagctcgatccttctggcattgattttaggagcgatgatctcatttgatatgggcggtcccgtaaataaggtggcgtttctgtttggatcggcaatgattggagaagggaattatgaaattatgggaccaattgctgccgccatttgtatccccccgattggccttggcattgcgacgtttttaggaaaaagaaaattcgaggcatctcaaagagaaatggggaaagcggcatttacgatgggtcttttcggcattactgaaggagcgattccatttgcggcgcaggaccctctgcgcgttattccaagtattatggcaggctcaatgacaggttctgtgatagccatgattggcaatgtgggagacagagtggcgcacggcggacctatcgttgcagtgcttggcgcagttgatcatgtcttgatgttttttattgctgtgattgcaggatctcttgtcactgctctgttcgtcaatgtactaaaaaaggatattacggcgtctcctgtgctcagtgaaactgcaccgacctccgcgccaagtgaagctgctgcagcaaatgaaataaaacagccaattcaaagccaaaaagctgagatgtcggaatttaaaaaactgacagacataatcagcccggaattaattgaaccaaatttatcgggggaaacgagggatgacatcatagatgaattgattcagaaattgtcccgaagaggtgcgctgctttcagagagcgggtttaaacaagccattttgaatcgtgaacaacagggaacaacggcgattggcatgaatatcgcgattccgcacggaaagtctgaggcggtcagggagccgagtgttgcctttgggatcaaacgatcaggcgttgattggaatagcctggatggatcagaagctaaattaatctttatgattgctgtaccgaaagagagcaggggaaaccagcatctcaaaatactgcagatgctatctcgaaagctaatggatgacaattatagggagcggctgctctccgtgcaaacaacagaagaagcatacaagctgctagaagaaatcgaataaagcgggggattttcatgacgactgaaccgttatttttcaagcctgttttcaaagaaagaatttggggcgggaccgctttagctgattttggctataccattccgtcacaacgaacaggggagtgctgggcttttgccgcgcatcaaaatggtcaaagcgttgttcaaaacggaatgtataaggggttcacgctcagcgaattatgggaacatcatagacatttattcggacagcttgaaggggaccgttttcctctgcttacaaaaatattagatgctgaccaggacttatctgttcaggtgcatccgaatgatgagtatgccaacatacatgaaaacggtgagcttggaaaaacagaatgctggtacattattgattgccaaaaagatgccgagattatttatggccacaatgcaacaacaaaggaagaactaactaccatgatagagcgtggagaatgggatgagctcttgcgccgtgtaaaggtaaagccgggggattttttctatgtgccaagcggtactgttcatgcgattggaaaaggaattcttgctttggagacgcagcagaattcagacacaacctacagattatatgattatgaccgaaaagatgcagaaggcaagctgcgcgagcttcatctgaaaaagagcatcgaagtgatagaggtcccgtctattccagaacggcatacagttcaccatgaacaaattgaggatttgcttacaacgacattggttgaatgcgcttacttttcggtggggaaatggaacttatcaggatcagcaagcttaaagcagcaaaaaccattccttcttatcagtgtgattgaaggggagggccgtatgatctctggtgagtatgtctatcctttcaaaaaaggagatcatatgttgctgccttacggtcttggagaatttaaactcgaaggatatgcagaatgtatcgtctcccatctgtaacatggcaggtcttgagaaataaatttgcgagtgaagacgcctattctccagcaatgatctaaataaaataagagtttaatagttggagaagaaatgttacactcttttctgtatatggtaaagaatgaaaaaacacgattcggttggtagtccggatgcatgattgagaatgtcagtaaccttcccctcctcgggatgtccatcattctttaatatcttttatgaggagggaatcgttatgaaattaacgatttactacgatggtcagttttgggcaggcgttgttgaagttgtgaacaatggaaagctaagagcctttcgtcatctttttggcaaagagccgagggattctgaagtattagagtttgttcataaccaactcctgaatatgttggcccaagctgagcaggaaggagttcgtttacaaggcagacgtcaaaaaaagatcaatccaaaaagattgcagcgccaggtttcaaaagagttgaaaaacgccggagtagcttctaaagctcaagaggcgataaagctagagcttgaagcaagaaagcaaaagaaaaaacaaataatgaaagaacaacgagaacatgtaaaagagcaaaggtatatgctcaaaaagcaaaaagcgaaaaagaagcacagaggtaaataatccaaacaaaagcaggcgcagtgcctgcttttgtaattaaggactctactttgtaacatatatccaatgtttataatccgctgatttatgattcaatataaaccctaacttctccaaggttttttgtgagcctagattatcatgttcgcatctagcggtgatccggtttactgtttcttggcttaatgcccagtttattagtttttgggcggcttccacacaataacctttgcggcgatgacttttatttgttgcaaaaccgatttcaatcatgccattttcgtctgggtcacctaaaaatccagttcccccaacaatttcataattgtccttctttacaataatccatgaatcaaatccttttgttccattgtttttgactaaaatctcgcggaaataaggtatcgcttcaaaaaaatcagaatttggccattcaccatttgtttcataacctaagtctttgatagcctgatgatctagtttagacgcggcgtcaagaaggggaatatcaatcgtttttaaacgtaatcgattcgtttcaaggagaaccatatatctaatcctcttttctttttacagggaataataataacatataacaattttctctggtaccttggcagtagagaaagatgaaaaaattgagggggattgaaagagtgacaggggagagtttgcccagaccaaaaacgggtaggaaaatgctgatgttaatgtgtccctacccgtttttctgttcctgaatgcagggtttctgataacatgttgtgctaccttttcgcaatcaaataaagcgatatggctctttgggtttgaacaggattatgaatgataatgacccattggtttcttcgtcttggaaagcttgctaccgcatacaatggagcagtatcgcgcggagtgaacccaccatttatcacgttgatatctcttccttcaagatgacaaactaagtattcacctggattgatgacctgttggttcgtccatgcgtaagaataaaagccgtctccaagatcttcggtggaagatggggggacaaagccatctacagtcaatgtgatttctcttcttcgctgtctttctgaaaaatctggacttctttgagggttatgagtatgtgaaaagtaaggaattaacgcagggccataaaagtaatgatacaaagcaaccactcctttattttccattcatacaaattgtatgtgggagttatttgttcattcctgttttgttccatgtagactaataatgggctataggcgtccaaggaaatcaatttgtcctttcgttgattcaatgctagtaaccttgaaaatgcaggttaggatgatagaatttacttattactgcaagaagttagatatacatcattttgatagtgggtgaaaacaatggcgaaaaaaatggcaaaaacaaatgcggttcgtctgatagaacagcagaacatctcttatgaggtattagggtataaaacagacggccagccggtagatggcatctctgttgcggaaaaaatcggttatcctttgaaatatgtatataaaacgttggttgcagcaacaggaacaaatcattattatgtctttgttgtacccgttgcagaagagttagatgtaaaaaaggcagcaaaggtgacaggggaaaagaaaatagaaatgattgcaatgaaggagctattagcggtaactggctatcttcgcggcggctgctcgccaattggcatgaaaaaattgttcccgacctatattgatgcatctgcagaagctcttgattttattattgtcagtgcagggaaaatcggtatgcagctaaagttggcgccacaagatttagccagatcatgtgatgccgcatttgcagaaattgtatagatgcagatataggggaacgaaaaagcttagtcatatcgactaagctttttccgcatccctttcaaatatgatttcaaaataagcagctgccccatacccatctatactgggagcgaaaatctgaacgaatctccagcctcttttcgcataatcatggatgatttgctggtagtcttctttaggccttcttctcatcgtactcagctcaactcttacgaattcatattctttcatcgtttgatccctcctattaaggtatacgtaaaatggagcgagaagttccgaaaacctaggttaaggtcnnnnnnnnnnnnnnnnnnnnnnnnnnnnnnnnnnnnnnnnnnnnnnnnnnnnncatcttgaagagttaaggggctataaaaacgaatttcaccgggtcagcagtccaaatgaatctcttgcttattgcatttgactgagtatataagtaaaaaaagagcggccagaacatataagaaggagatgatcattaacgcactcataacagggtagtatttagcggagtagatgaaaaaatcaagctgtgaaatttgtttggggctgctgacggcatcaattccatttagcagttttgagagtttagcagtatagttccaatcaaatcgatctgaaacaagctcgcttccttgataccaattaacagcagctaaaaacagaaataccataatagaaaatccaagctgaacaactaaaaatattcccttcacttttgtatgacctccaaatctatgaatatgggaaaatcaaacaatatattaccaccgtatgggttattcttgcaatttcactttcactttcatacaactcaaacgcaagtctatttttttgtttgtttttggcttataatacctgatgatggaaaaagagtgcgggtttatagattagagaaacaaatgtatttcttagcattttttatttgtggagagagtatagaagcattcgattagatctgctttttcacagaaacgcttttcatctgtttgcctgagctttacaattggctggcaaaaaaacaatgatttctttcaatcaaaacatgcaacgatgcgacatattttatatcttgatgacttatctcattgcctttaagtcattctatcgagaaagcgatggtattttatgaacaaagaaaccctaaaaaacatactcatgattttttcaatatgcgcaaccctccgagaaaccgatggtatgcgcatagctgatagctggattttgagtgcattttgagtgcatggctgtgttttttgccatgacatttctattagatgctgtttttccaaacaaaaaagagtcacattaatgtgtggctctttttgcatcatctgatcagaaacatcataaatgaatcgatcatcatgatgaagaacagcaagcaaaaataaataagcgagtagacaaacatatcctttgcccacttcacgtcatcgtctgttttgaatcctttgatgctttttttgatccatatgcctccgagaaccaaggcggctaagaaataaaatgggcttatatggccggtgcctagagagaaaggaaataatagcgtgaccggcaccaggacggcaatatattgcatcatttttatttttgttacatgattgcctttgactactggcaagagcggaacgccagcagcgcgatattcctctttgcgtcttatcccaatcgcccaaaaatgcggcggctgccacagaaacataatcgtgtacaacagcactgctgtcatactgaagtcaccggttacggcacaataccccatcaatggcggcgcagctcctgggaagctcccgacaaatgtgctccacacagacgttcgtttcacccataccgtatagatgatcgcataaaaaataaaggcggccagtccgagataggccgttaatggattgagggaataaagcatggcaaggcctgcgatccctaaaacagagccatatgttaagatcatggctggcggcattttccctgtgaccgaggccctgctgcgagtgcgtgccatttttgcgtccatatgccgatcaaaatagttgttatagacagtgccggaagccatcacaaacgcggttcccaacattgctgttaccattgtcatcaaaaaagccaagccggttaacgttttttctgcgcttgcaaacgcgatccaaaacccgccgaaggctgctatcgagtttgatatgataatgcccggctttgcaagtttgataaaatcgtaaatggttacccggttcgaagcttttatgtattttgtttcagatatggctgcagaatctcttgtattctccaaaaatagacgcctcccccaaaactgcatgcttttgttatcgtaacaagagggggacagaatcacaattatttcctatatttgtcatgatattgtcatttttaaaacaaaaaaatggggagctggactgcccccattttgatatgcggcgactagtaaccgtaacctccgccatatcctccgccataaccgccgccgtaaccgtgccaagggtagtaaggcggtcgcgggcgcgggtagtaataaggtgggcgcggataaaacgggtagaacggataatacggtcttggataataataaggcggataaaatggcggtctcggacgcggataataataaggctgtctttcatcataaggggtaatttgttcaaatgactgttcattcaaagggtaatccaagaggaaaacctccctagctttttttattccttttaccatattcctgatgcttaagttgggtgtatgtacattcatgaaattcggttttttttatgatgaaattccttaaaaaggattgacatgaacttctaaatctcatagtattacaaatgtgaaataaatgttactacaatgttacaaaaacatttctaaatagatacagttccaactgatgaagagtaaatcgaaatggctacgaaagaaggagtttttgttgttggcaaaaagaatcaaatggtttcatgtattaatagcagttgtatgtgtggtgggccttatcggctttttccataatcattcattgaaaaaagaaacggtcatgaataaagtaagaactgattctcaatatgggaatgttgagatcgcaacgcttgtgaatgacgggaaaacttttaattacgcggttaactatcccgttttcaaaaatgaaaaaatggattcggcattaaaaagattcgcagaaaaagaggttcgtcaatttcaaaaggaaacaaaggacgttgaccaagagcatacgacaaaacgcaacgaattaaatgttgattataaaattgtccattatgccaaacagacagtggcgattgtatttaatgaatataaatacatcggcggggcacacgggcaaaccgtgaaaaaaacgtttaactatgattttagtaaacaagcgtttctttccattgatgatattttcaaagaggacgctgactacttacataagctttcgttaatcgcttatcacgagctgaaaaagaataaggacattgccgcggacgatgcactgttaaaggaagggacggctccgaaaaaagaaaatttcagccgctttgccatcaaggaggattatatcgaactttactttgacacatatcaggttgcagcaggctatcttggagagcaatcgattgccattaagaaaagtcttttgaaagacattctgaaagaacaatatattgataaagcaaaaaataaaaataaaatcaaagaacaaaagccgaagcatgaagtgatttctttacccaaagaggaaacggttgatccaaatcaaaaagtcattgcgcttactttcgacgacggcccgaatcctgcgacaacaaatcagattctagactccttgaagaaatataagggtcatgccacgttttttgttttggggagcagagttcaatattatccggaaacgctaataagaatgctgaaagaaggaaatgaggtggggaaccattcatggagccatccgcttctcacaaggctttcagtgaaagaagcgttaaagcagatcaatgatacgcaagacatcattgaaaaaataagcggataccgtccgacgcttgtaagacccccatacggcggcattaatgatgaactgcggagtcaaatgaaaatggatgttgcgttatgggatgttgacccggaagattggaaagaccgtaacaaaaaaacaattgttgaccgtgtcatgagtcaggcgagagatggaagaaccattttaattcacgatatttaccgcacctctgctgatgcggccgatgaaattatgaaaaagctcaccgatcaaggatatcaattggtgacggtttctcagcttgaagaggttaaaaaacaaagagaagcgaaataaattacaaaaggctgtccgtacggacagccttttttctatttaataagagcctgtggtggcccaaacatttaagtttggtcctgaatacttgccaaaagcgtaagaagtccttggatctaaatcatataccatcggtgtatagcaagacttttggccggccaccgcttttccattgccgcctgcagaatcacaattatatctcttgccgtccgtgttccgggtaatctccgcatttgcttcaaagccagacgtcaatgtattattcatcgtgatttttgcccaagccgttttacatgtactgctgaatttaagctcgactactccgatgacttgattgcttgcattcactaagtttgaggatttttttgtagagccgctggacgcacaatcattgtaataagggctttttccatcgtaggcatgggtttccgcattggcgggtacacctttgacggcaaaaacaaatactactgcgaataacaccaatgaagccttcgtaaacagtcttttcatatcctttatgacctccttaatatggcaaacaataaatcatacggaggaacaatcaaaacatgcatgcttttttgtgaacaataaaggcggccgggaggatggagttattggccgcctttggtgtgaggttaagcttttacatcaatggtttgtccgagagtcggatgctgaatcatctttaaggtttgatcggcattttgctgggcggtgtccagcatttttttcgttaaagcgatattaacattctgggcaagggatgcttgatgcattgcaaccgataaagcaggaatatccatcgttccacctcctatgccttacctatcggcggctttgtatcattttacagtgaaaaatggcttaattttcgctgttgacccctacgctgcggcatatcgtatgtttttgacaaggagggaatcaggatgaatcttgtcatggaaaagacctttgagcaatacgaaaagctgttttcaatggaagaacagaaaagagaagatgaatttcggtatacgatgatgaggccgtttgaaaagatgtggaccgccatccatgttccgctgaaagcgaaggagccaaacggctatgatgtgatcatggctgcgaaaatgcttggctatttggatgtccgtgatgttgaaatcggacagaaagcactgcgaatactgaaagaatcacatgtttcagagactgcggaatctgcacttcggcaatgcatattttttgatgagcgcgaacagctgcgggtgaatgcaaaggagatcaaattcggcctttatatcgctgatccaaataagcttcagctgcaaaaaggctactgcgggtttggcgggataccgggctttattcatgtatggattaatccgaaccattataacctgccaaggattccttccattattgctcatgagtttcatcataatgtgcggttttcgtatatagattttcatcatggctctgtaagtgtcggggattatcttgtgattgaaggattggcggaatcattcgccagagagctgtttggtacggaacgattgggcccttgggtaactcgttttgatcatgaggatttgcaatattccattgatgtgattaatgaggtgttggatgtgaaaggagtttcggaagtcagccgttatatgtttggtgatccaattgctaacgaccaaggctttaagcctgcaggtttatcggcttttgcgggttatgcagttggctatcatgccgttcagtcatttatgaatcaacatcatatcacgataagcgaggccacacgtttggatgcgaagaccattctttctcaaagcgggctgttttctacatgaaaaaagcgtcacatacagcggcgctttttgattcccaaaaccagcagttctatggcggcacaggcggcaattccgattgtatatgcttcgatatcgctccataaaaaaccgtaccccagtacaagcccgccaagagaagtatccctaatctggtcgatccattcggcatgatagagctggctgaattcaatgacaaaacagaaagaaagactgataatgcccgttatcattgtcttcagcttccgaaatagaaatccgcatcccgtgaagatcatggcggcccacaacgagtctcccagataagtattgagggtatcaggaagaacactggagaatgctctggatccaagccccagcccaatgatcagtacggtgaaaactgcatatatccaacgatttcgcttcattgcgaattgataccccgtctctttttcatctccctgtattgtaaggaatatatcttttatttgtccactaaaaaagcggctgaatagccgcatagggtgtttattttgcttttaggtttacatggtcggctgtctgatctgtgcctattacaaaatggagttcatagcggcctgtatcatatacataatcgatttcatcggtaaacgggacggttaacacccgatttgctggccctaattgcttctgcagcacttccggcgtaactccgcctaaattcagctgacgttccacaccggttccaaagtagcggatttctgaaattgtcatgtctttatgataggaaaatccgtagcccggctgtcccatattccagtgatataaatcaaatcgattgtctcccccgactggtctttccggttccccaaacgcagcgtggacatcgccttttgtgcttttgttaatggtaaggccttgcgcctgctgaggcatttcccctttataggcggtgttatagaggtttttgacaagctcggcggctgattgattcgtgttttctgagagcgtgtttgtttgagctgcggcctttgccggtgctgaaaaggacgcagccccaaagccggtaaaacagcttgttactgctgccgccgcggtaatagcagacattgtctttttcatgttaatccctcctaattgatctaccattccgtttccccgtgtttttgcaacgaaacatgtgagtgcgctttgtatgttttattgagttgttgtaagggaactgaaataggtaattcggtatataaagcaagaaaggggaatggagatggctggcaagaaaacaatcacaataaacggcgttgaaatggaagcgtccgaggaacagacggtgctgcagcttttgaataacagctcgattgaagtgccgcaagtttgctatcatccaagcttagggccgattgagacatgtgatacgtgcatcgtcagcatcaatggtgagctgaagaggtcgtgctccgctgaattaaaggatggggatgtcattgatacgctctcacctgacgtgaaaaaagcgcaggtcatcgggatggacaagattttatataatcatgagctttattgtacagtttgcgattacaacaatgggggatgcgaaatacataatacggtgaaggaaatgaaaatcaatcaccaaagcattccgtttgatcacaagccataccataaggatgaatcccatccgttttatcggtatgatccagatcaatgtatattgtgcggacgctgtgttgaagcatgccaggacgttcaggtaactgaaacgctgaccattgactgggagcggaaacgcccgcgcgtcatttgggataacgacgtgccgatcaatgagtcgtcatgtgtgtcatgcggtcattgttcaacggtctgtccgtgcaacgcgatgatggaaaaaggaatggaaggggaagccggatatttaacaggcatcaataacgaaacgctgcgaccgatgatcgagatcacgaaaggcgtagagacaggctacggctcgattctcgccatttctgatatggaatcggccatgcgtgatgaacgaatcaaaaaaacgaaaaccgtctgcacgtattgcggcgtcggctgcagctttgatgtctggacaaagggcagagacattctgaaagtagagccgcaggaggaagcgcctgccaacggcatttctacttgtgtaaaaggcaagttcggctgggatttcgtcaacagcgaagaacgcctgacaaagccgctgatccgggaaggcgaccatttccgtgaagcagagtgggaggaggcgttattgctgatcgccagcaagttcactgaattaaaagaggcgtttggcccggattctctcgcttttattacatcttctaaatgtacaaatgaagaatcctatcttatgcaaaagctggccagaggggtcattggcacaaataatgtggacaactgctcccgctattgccaatctcctgcgactgccggcctgttccggacagtcggctatggcggtgattcaggatcaattacagatatcgcgcaagcggaccttgttttgattatcggttcgaacacgtctgagtcgcatccagtcttatccactcgcattaaacgggctcataagctgagagggcagaaagtgatcgtcgcggatatcagaaaacacgaaatggcagaacgctccgatttatttgtccagccgcgtgccggatcggatatcgtctggctgaatgcgatcgccaaatatttaatagaaaacggcaaggccgatgaacgatttttgagagaaagagtgaacggacgggatgaatatgtaaaaagcctcgcgccgtacacacttgaatatgctgaggagaaaaccgggattgatcaagaaacccttatccaaatggcagagatgatcgggcaagctgacagtgtgtgtgcattgtgggcgatgggcgtgacacagcacattggaggaagcgacacgagcacggcgatctctaacctgctgcttgtgacaggaaactacggaaaaccgggagcaggttcttacccattgcgcggccataataacgtgcagggagcaagtgacttcgggagtatgcctgacagactaccgggctatgaaaaagtgacggatgaacaagtccgccaaaaatacgagcgggcgtggggcgtgccgctgccgaaggagccgggtatgaccaaccacgaaatgattgaaaaaatccattccggacagctgaaagcgatgtatgtaaaaggtgaagaaatgggccttgtcgactccaacatcaatcatgtacacgctgcatatgaaaagcttgatttctttgtggtgcaggacattttcctttcacgtacagcggagtttgctgatgtggttcttcctgcgagcccaagccttgaaaaagaaggaacgtttacaaacacagaacgccggattcagcgtttgtatcaggtatttgaaccgctgggtgaatcaaagccggattggcagattattatggaggttgccaataagcttggcgccgactggcactataagcatcctgcagacattatggaggaagcagccaagctgtcgccgatttatgccggtgtcacctatgaacgtcttgagggctataattccctgcaatggcctgtaaacgctgatggaaaggattcgcctttactctttacagagcgcttccctttcccggacggcaaggccattctctaccctgtccagtggacagagcctgaggaattcggtgaggaatatgatatccatgtcaacaatgggcggctcttggagcacttccacgaagggaacctgacttacaaatcaaaagggatttcggagaaaacaccggaagtgttcttagaaatttctcctgagcttgcggcagaacgagggattcaggacggaaccctcgtcagactcacatcgcctttcggaaatgtcaaagtgaagtgcctgattactgatcgagtcaaagggaaggaagtatatctgccaatgaacgattcaggggaagcggcgatcaacctgttaacaggcagccatgccgataaggataccgatacgcctgcttacaaagaaacatcggccaagatggaaattttgaagcacgacggaatcagcccgctgcctaagatcaaccaccgcaacggcaatccgcagccgcaaatcggtgtgcaggttcataagaaatgggcgcggaaggattatattttccctggtgacgctgtgaaaagggggatgggccataatggctaaagcgattaaacgaatccaaaaaatcgaggtaacagaagaggatcagcgaaagcgtgatttgcgggaaattgaagatgctctaattgaccacaaagaagcgattctcgaaacattgcatatgctgggccatatgaacgagcgcggtgtcctgccgttgctccgcggcctttttggccaaggggataaagttcttgatatcctggtgaaaaaggcagatacagaggaaacagccaatacgctgaaaaatctgcttcttctgtttggaacactcggcatgctggacgtgaagcagctggagcctctcattttgaaagtgaatgcgggtgtggcaagcgctgtagagcagaaaaacagtgaagaaaagacaggttattttgatattatccgctcgctaaaagacccggaaatcaacaaatcaattacactgctcttttcctttttaaaaggaatgggacaagatacaaaggagctggaacgcacgacgcagcctccggaacaccaaaaacatcatcaggaacctcgagagaaaagaggaatgaataagcgagattgacctcccgcccgagcggcttcagccagctcgggtttttttgatgaaaaggtctaatggactagtaaaaaatattcaaatactaggaagaagtaagattgtgatgaatgagatagaaataatcgttactttcttacctgttaagaaaaggaaaaatctgattataatagaaatcgattactttagatgggggaacaatcatgaaaaaagtcttattactattatttgtcttgacgatcgggttagcgctttcagcgtgcagccaatcgagcgatgcgtcagagaaggaaaaaccgaaagagaaaaaatcgcaagaagagcttgaaaaggaacttgataaggaattgaaaaaaggcggtgagccgaagaccaaaaaagatgatcaaatacataaaataggagaaacaattaaagtaaatgatattaatttcacggtgaataaagtggatcgtgaacagaagggtcaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacgttttcatcagggaagaagcgtgctttttttatagtgacaaataatgtgaaggggagagtgataaaagtgcaaaccaaatggctggaacgggcacagcggattcaagcgattgcacaggctgggcttgctttttccaaggatgtgtacgacagggagaggtacgaagagctaatgaagctcagtgcagaaatgatggtggattactcacagacggacattgaagttatcactgatttatggaatggggagagcggctatccgacaccgaaagcggatgttcgcggcgcagtattccgagagaatcagattttgcttgtccgggagaagcatgatgagctgtggtcgctgccgggtggattttgcgagattggtttatcgccagctgaaaacgtcgtcaaggaaatcaaagaagagtcggggtacgatacagagccgtctcgattgctggccgtgctagacagccataaacactctcatccccctcagccttatcactattataaaatcttcatcgcatgcagcatgacgggcgggcagggggaaacagggatcgagacgaatcatgccgctttttttccggaagacagcctcccgccgctttctcccaaacgaaacacaccctcacagcttagcatgctgtttgactttttgcgccatccggacaagaaaacgatatttgactaaaaaagaaagagcctgtgggctctttcttttttataatgtaatgtgtttttcgttggcgagtttcagaagggtcaaaatagaatcggcttgtttatggccgagtttttgctttaatttgttttcttcaactaatcggctgccataaattttgacggaggctttgtcgacgacagtatgccagttttcctgtttttttccctcaacaagcggtttttcatgtctctcagaaaaagagaacacaaagagtacgaatgcaagtgaaagtaggattccgacaacttgttttttgtaatcagtctgtgctgccacgttgttctctccttcaccttttaccttctatttaatcatagaaccaaattattttacataatgggaaagtcatttttggagttagtgcatttggttgaaaacagagacgttttttgagcggagcggtgcaattgaatccatattggatttgcgtgcttatgcctaaggtcacgttgtgagccaaaacagcagtgcagaatagaaaaaaattgaaagattatggtaagatgaacgaaattcgagggggaatatatgatgcctgcatcgaacatcgtgatcgcctgcctgctgttatcaatttaattatttgtggtagtccctctctttttcgaaagcgggaggtgaagtggaacattaattgctgaattctttcaaggggagtgaccgtacatgaatgtgttaaaccgccggcaagccttgcagcgagcgctgctcaatgggaaaaacaaacaggatgcgtatcatccgtttccatggtatgaatcgatgagaaaggatgcgcctgtttcctttgatgaagaaaaccaagtgtggagcgtttttctttatgatgatgtcaaaaaagttgttggggataaagagttgttttccagttgcatgccgcagcagacaagctctattggaaattccatcattaacatggacccgccgaagcatacaaaaatccgttcagtcgtgaacaaagcctttactccgcgcgtgatgaagcaatgggaaccgagaattcaagaaatcacagatgaactgattcaaaaatgtcaggggcgcagtgagtttgaccttgttcacgatttttcatacccgcttccggttattgtgatatctgagctgctgggagtgccttcagcgcatatggaacagtttaaagcatggtctgatcttctggtcagtacaccgaaggataaaagtgaagaagctgaaaaagcctttttggaagaacgagataagtgtgaggaagaactggccgcgttttttgccggcatcatagaagaaaagcgaaacaaaccggaacaggatattatttctattttagtggaagcggaagaaacaggcgagaagctgtccggtgaagagctgattccgttttgcacgctgctgctggtggccggaaatgaaaccactacaaacctgatttcaaatgcgatgtacagcatattagaaacgccaggcgtttacgaggaactgcgcagccatcctgaactgatgcctcaggcagtggaggaagccttgcgtttcagagcgccggccccggttttgaggcgcattgccaagcgggatacggagatcggggggcacctgattaaagaaggtgatatggttttggcgtttgtggcatcggcaaatcgtgatgaagcgaagtttgacaggccgcacatgtttgatatccgccgccatcccaatccgcatattgcgtttggccacggcatccatttttgccttggggccccgcttgcccgtcttgaagcaaatatcgcgttaacgtctttgatttctgcttttcctcatatggagtgcgtcagtatcactccgattgaaaacagtgtgatatacggattaaagagcttccgtgtgaaaatataatagataaggagactggagattcatgaaaaagtaccatatttcgatgatcaatatcccggcgtacggacatgtcaatcctacgcttgctttagtagagaagctttgtgagaaagggcaccgtgtcacgtacgcgacgactgaggagtttgcgcccgctgttcagcaagccggtggagaagcattgctctatcatacatccttgaatattgatcctaagcaaatcagggagatgatggaaaagaatgacgcgcccctcagccttttgaaagaatcactcagcattctgccgcagcttgaggagttatataaggatgatcagcctgatctgatcatctatgactttgttgcgctggctggtaaattgtttgctgaaaagcttaatgttccggtcattaagctctgttcgtcatatgcccaaaatgaatcctttcagttaggaaatgaagacatgctgaaaaaaataagagaagcagaggctgaatttaaagcctacttggagcaagagaagttgccggctgtttcatttgaacagttagctgtgccggaagcattaaatattgtctttatgccgaagtcttttcagattcagcatgagacgttcgatgaccgtttctgttttgtcggcccctctctcggagaacggaaggagaaagaaagcctgttgattgacaaggatgatcgcccgcttatgctgatttctttgggtacggcgtttaacgcatggccggaattttacaagatgtgcatcaaggcatttcgggattcttcatggcaagtaatcatgtcggttgggaaaacgattgatccagaaagcttggaggatattcctgctaactttaccattcgccaaagtgtgcctcagcttgaggtgttagagaaagctgatttgttcatctctcatggcgggatgaacagtacgatggaagcgatgaacgcaggtgtgccgcttgtcgtcattccgcaaatgtatgagcaagagctcactgcaaatcgggttgatgaattaggccttggcgtttatttgccgaaagaggaagtgactgtttccagcctgcaggaagcggttcaggctgtatccagtgatcaagagctgctcagccgcgtcaagaatatgcaaaaggatgtaaaagaagctggcggagcggagcgtgcggcagctgagattgaagcgtttatgaaaaaatccgctgtcccgcagtaaaaacataaaaaccgaaatcaatttgatttcggttttctgtttaaatattttttttcatcccgcatctccggcattctctaagaaattttccgccttttacagagcttttgaacagtgtgtaatcacagttgtcgcagcgcccgctgcgggcgtccggatattcattgaattcgtaaacaatcgatgtatcgtagccttttgtttcatattcttctttttttgtttccatgtcgatcctccgttacaagacgtgtctgctgtttatcttacagcaagcttccggcgtattcaatggattttaggaggttgggtttatcttgatttctcccttggtttgcgccaaaatagctttattaagcttatatacataaaaagcctatgcaaagaggagaggaaacgggtatgggaaaagggttacttggaaaacgcgtggcaatcggtggctcacgaaaaacggaagaaattagtacaatcattgaaaaacagggcggaatacctgtcatccggcctctccaaggtacagtttacttagcagagaagcaggtggagccggatttgcggacgtttgcggaagaaaaagctgactgggtcattttcacgacaggcatcgggttggagactcttgtcgatatggcagagaaaattggactgaaagatgagtttctgcaggccattcgccaagcgaaagcggcatgccggggatacaaaacgctgtctgcgctgaaaaagcttggaatcacaccggaagcttcggatgaagacgggacaacaagaggcttaatccgttccttggagcctcacgacttttcaggaaaaacagtcatggtgcagcttcatggcgaaaaagcgccggctctcatggcatttcttgaagaaaaaggcgcgtctgtcctgccgattctgccttatcagcacatcccgccggaggaggaaacggtggagcagttatgccgagagctgatgaacgatgaggtcgatgccgtttgttttacaacggccattcaggttcgttccctgtttgattttgccaaggggcgaggttatatcaatgaagtgaagaaggtattcgaagaacgcgccatcgcagctgctgtcggaaaagtgactgctgaagcactgcgggaagagggcattacgagactgcttgcgccagagattgagcggatgggtgcgatgattgttgagctggccaagtattatgaagaaaaggaataacaagtacaaaaagccgcttttccctcggaaagcggcttttgtctgtcattcattctgcttcagctgctgatgaacggtgaataatgatgggtatgtcagcacgcttaagattacacaagtcagcgcggctgaggccatcgttgtaaacacgattaagagttgaaagcgtactgcctgaatcgggtccgcgccggctagaatctggccagtcatcatgccgggaagctggacaagacccagtgttttctggctttcgagcgtcgggatcatactcattttcatcgctgaggtaagaatgcgctgtatggattgcttcggtgtgccgccaagtgacaatattaattgaatttcttctttgcgaacgccgacttctgagttaagccggtttagaaacaaacttgagagcaccatcgaatttccgatgaccatcccgctgatcggaatgacatatcgtgccgtaagcggaatgatatgaagagacagcagaattccctgcgtcacaatttctacgattgctaacgcggcaaacaccctccaaaacgaaccgatagtatttttctttcgcttgatgacattttgcgccgccaccgcgagcattaacagcaccatcagcaggataaaaacagggtggtctccgcgaaaaatcagcgacaaaacataaccgatgataagcagctgcaccgcggcccggatggtggcgatgatcatgtctttttctacaccggctttaaaggattttgataaaaacaaggcgatcaaaacaaagatcatcgttaaagagagagaaaggtaatccattaccgagtgcctcccttcaaaaattctttcgctgcttcatgctgcggagcggagaaaaatgtgtcggtttcagcgatttcaagcagccggccatctgccataaaccaaatggtatcggctattcgttttgcctgctccatattatgagtgacccacatgactgtccattttttctcttgatgctgacgtttgatcagttcttcaatctcaagagcagaaaccgggtccaaggccgatgtgatttcgtccaacaatagaatggaggaaggatttgagagcgttctggccagtgacagtctttgccgctgcccgcccgataagtctctggcgcttctgtctaacaactctggcggcagccctgcaagcgaagccagcttttcaggagagtacagctgggattgatgcagcctttgtacaagacttaaattgtcacgcactgtcccgtcgagcacgggagccgattgaaacgcgagggctgccgttcgcctcagctcattgacattccattctctgacttcctttccgtatatgttgacttcgccgctgtcaggcgttctcattaaattacacatagaaaggagggtgcttttgcctgagccggaaggacctaaaacggctacgattgcgccctgttgaatgtctccggtgacatcctgcagcacatcataggtttgtccatcttgtttatagctttttctgactgatctgaaggagatggctggtatgttttgtgtttgatcgtttgcttccattacaataatcacctttcaatataagtaggctgacattatatttaactataacgtgaaacagattccttttggtagcacaaataaaggagaacaggctttcacccattctcctgcagatgctaagcagtcagatttgactgtgctttctttttcggttttctcggctgtgaagcgaaggtatgtaacatcatccccgctattataatgaacaaaccggcaaatgataaaagagatgggaaaacgcctgacagcagaacaatttcaccaagcaacgcgaaaatcacttcaccggattgagtggcttcaacggctgcgagtttttgcggattgtctcttaccatatcagtggcccagaaaaataaaaccgtcgcaatgatgcctgagctgacggctacgataaaggattgaacggtttggcttgctgttggaaggccgtctgaccaccagccgtaagctgctaatataagccagaatggaaggcttgccaatgtcattccaagcacgcgctgaaatgtatcaagccggcctccgtattcttcgagcattctcctgtttcctaacggataggcaaaagccgcaatgacaaccggcagcacactgaaaagcagcatcctcccagaaagcgattctgcatgctgaagctgaatcagagccgctccaatcaggatgatcatggaagtgccaagtgaaaccaggggaatcttttggcgaacgaactgcggaccgcccggcatatcttgtttgacataaaacaaaggagataagagcaccccggctacaattgtaatttgccaggttccggctatgagccaccccggaccgtatgcagccgcaaatgtaatcggcgcgtaaaaaagcacgaagccgacgaagctccatttgatccaataaaacggctttttcctcatctctagtaagagaggcgtgaatgtccctctcatgatgacaatcaaacataaaaacggcaccataaaaataaagcgcagcgaagagctccaaagccagctgcctcctgataactccatcgctctgtttaatataaaggtaacggcgaaaaagagtgaagccaatattccgataacgatagctttcatgatatccctcattctggcattatttttttatactatactattcggtatcatgcagatcaatggaatcatgagaaaaacatcatgttttgcgaaccgctatgtgtggaagacaaaaaagggaggtgaaattgatggaaaaagagacacagacatacttctttccggatgacggcaggattccgaatcaccctgattttccgctcgtggtgtatcaaaacgcgcttaaggacaccggactggcagagcggatcgtcatccggcatggctggtcaaacagctggtcagggagtgtttttccataccatcattatcacagcaatacgcatgaagtcctgattgcccttaggggagaggctgtgattcagtttgggggagaaaaaggggctgccatctctttcaaattaggcgacgcagtcgtgattccagccggagtcggacataaaaagctcagctcaagtcccgattttactgtccttggcgcctatcccggtggcgttcagtatgatatgaagacggggaaaccgaatgagcgggaggaagcgctcaaacagattaagcaggcggcgttgccggcgaatgatccgatcacaggaaaaagagagcctctattggaaatatgggtaaagtgaaggggagaaattgctggattgtcaataactagtgccgcagaaacgatatgacatgagctccatataaattaatttcataatcgaagcaattcacgttcaaattttgttcaaaaagtgttatcatatagaaggtaatcgaattggagttttttgtgtttgctattttcagagagagtaaaggattttgacttattcaattgtttatttttagataaaaataatactgaatatggcaagatgaaaaactgggtagtaaacatttatttttgtaaatgattgtgcacgaattcacaatccttattcttatgccttaaaagcgtgagacagggagaggcactaccctttccaaaaaaatcagcaaactgcttatagtaaaggagaattggatatgccagaaacaatcgatcaaacaaatgcgtctgtcagccaaagccagcaagatcttattgatcagctattaaagccagaagttcaagaatcattgactgttttagttgaccagcttccgaagctgactgagttagtgaatattttaacgaagtcttatgatttcgctcagtctgtagcgactgacgaagtgttaaaaagcgacacagtcggtgcgatcactgaaattcttgagcctgtaaaagaaacagcgaaagaagtagctgcgactgcgatcgaagcaaaagaccgcgcggaagcaagcaacgaaacaattggtcttttcggcctattgcgtatgctgaaagatcctcaagctcaaaagctgttccgttttgctaacagctaccttgaagtcatgaacgaacgcgaaaaccaaaaataatctcagattcaaattgatataaaggacggaggatatacgatgtcaaaacatattgtcattctaggcgctggttatggcggagttctttctgctctaacagttcgcaaacattacacaaaagaacaagcacgcgtgacagtggtaaacaaataccctactcaccaaatcattacggaattacaccgccttgctgcaggcaacgtgtctgaaaaagcggttgcaatgccattagaaaaacttttcaaaggcaaagacattgatcttaaaattgcggaagtaagctctttctctgttgataaaaaagaagttgcgcttgctgacggttctacattaacttacgatgcgcttgttgtaggtcttggttctgtaacggcttacttcggcatcccaggtcttgaagaaaacagcatggtattgaaatctgctgctgatgcgaacaaagtcttccagcatgttgaagatcgtgtgcgcgagtactctaaaacgaaaaacgaagcagatgcaacaatccttatcggcggcggcggcttaacaggtgttgagcttgttggtgagcttgctgacatcatgccgaaccttgcgaaaaaatacggcgtagaccataaagaaatcaaattgaaacttgttgaagcaggtccgaagatccttcctgttcttccggatgatcttatcgagcgtgcgactgcaagccttgaaaaacgcggcgttgagttcttaacaggtcttcctgttacaaatgtagaaggaaacgtaatcgatctgaaagacggatctaaagttgttgccaacacatttgtttggactggcggcgtacaaggtaacccattagtcggtgaatcaggtctagaagtgaaccgcggacgcgcgactgtaaatgacttcctgcaatctacatctcatgaagatgtattcgttgctggagacagcgcagtttacttcggtccagacggccgtccatacccgccaactgcacaaatcgcatggcaaatgggtgagctgatcggttacaacctattcgcttacctggaaggcaaaacgcttgaaacattcaagccagtaaactctggtacacttgcaagccttggacgcaaagacgcggttgccatcattggtgctaattctacaccgcttaaaggtcttcctgcttccttgatgaaagaagcaagtaacgtacgctacttaactcacattaaaggacttttcagcctggcttactaatccttttaatgaatctgacattgccaaaagcgttccttaccgagtgctttctggcaatgtcttttttatgtttatgacagcgttaacatttcattttcaaaaaagagattgatcccagaggaatataaaggtaaaataaaaacaaatcaaaatgttaacgttaacattttgaaatagaatgaaagacggtgaggacatggaacccttcatgggcgaaaactttttattgaaaaatgaaaccgctgtcagcctctatcataattttgcgaaagacatgccaattattgattaccactgccacttaagtccgaaagaaatctatgaaaataagacatttcaaaacatcacggaagcctggctgtatggtgaccattataaatggcgcatcatgagagccaatggaattgaggagacatacatcaccggagatgcgcctgatgaggagaaatttatggcttgggcgaaaaccgtgccgatggcgatcggcaatccgctctataactggactcacttagaattgcagcgtttttttggcatttatgagattttaaacgagaagtctgggccggctatatggaaacggacaaatgaactgctcaaaggggaaggcttcggggcaagggatttaatcgtgaaatcaaatgtaaaggtcgtgtgcaccacagatgaccctgttgattctcttgaataccatctattattaagagaagacaaagactttcctgtcagcgtgctgcctggatttcggccggataaaggacttgagatcaatcgtgaaggctttcctgagtgggtgcaggcgcttgaagatgccgccgccatatcgattacaacctatgatgagtttttaaaggcgttggaaaaacgagtgcgattcttccacttagccggcggcagagtttctgatcacgcgatagattcaatggtatttgccgaaacaacaaaagaagaagctggacggattttttctgacagattacaaggaacagaggtttcttatgaagatgagaagaaatttaagacacatacgcttcagtttctttgcggtttgtatgcggagctcgattgggcgatgcagtttcatatcaacgctttaagaaacacgaatacaaaaatgatgaaaaggctcggacctgatacaggctatgattcaatgaacgatgaagaaattgctaagcctttatacaagctgctgaactcagttgagatgaagaaccaactgccgaaaacgattttatattcactgaatccaaatgataactatgtcatcgccagcatgatcaacagttttcaggacggtattaccccaggaaaaatacaattcggcacagcctggtggtttaacgatactaaagacgggatgctcgatcaaatgaaagcgttatcaaatgttggccttttcagccgttttatcggcatgctcaccgattccagaagctttctttcgtatacgcgtcacgaatatttcaggcggatcgtctgcaatttgattggagaatgggtggaaaacggcgaagtgccgcgcgatatggagcttctgggaagcatcgttcaggggatttgctatgacaatgcgaaacactacttccaatttcaagaagagaaagcaaacgtgtaacaaagtgtccgctcagcatcgctgagcggatcactatccgaaaattcttaagacacagaggtggaacatgcgaactgaactggcaaataaggttgtgtcggtcgaaacggaaaaaaggctttcattgaaagagaaaatgtcttatggttttggtgattttggcaacggttttatgtttgatctcggccagatttatttattgaagtatttcactgatgtagcgggaatccccgctgcgatggccggcggcatttttttagtcagtaagctgtttgcagcgataacagatccaattgtcggctcatcaatcgattatcgcaaaaacattggcaaacgggggaaattcaggccttatctattaatcggcagcatcgtgcttgcggtgcttactgttcttatttttctgtctcccaatgtatcaacgaccggaaaactgatttatgcatatgcatcctatatgatttggggcatcggctattcgtttgtgaatattccgtacggctcattaggggcagcgatgactcaaaattctgaggaccggacctccatttcgacgttccgccaaatcggatcacttggcgccttgtttatcacaagtgtggccgtgatgccgctgctcgtcaagtttgataatccgaaggtcggctacccagtggtcatgggcttgttcgccgcgctcggtgtgttttggttttatatttgctaccgcaactgcaaagagcgcattgtcatatcggaagcaccaaaagaaaaattaacactctcatctgtcgtcaaaacatttattacaaataaaccgctgttaacccttgtcctgatgacgattttttcaatttccgcatacaacattaaatccgccatgctcgtctatttcgcacaatataacttgggcaatgttgaattaatggcttatatgaacttcatcattattggttcttcctttttgggcgtcgtattccttccaaagctcgtcaagatgtttggaaagaaacgaacggcaatgatcggcttcggcatcagtgtggccgcggatctgatcaactttatgctcccatctaacgtatatgtgtttacaattctcgccagtatcgcctttatcggaatcagtatcccaaatggcatcacgtgggctcttgtctccgatattatcgactatggcgaatggaaatccggtgaacggaaggaagcaacgacatattcacttttcaatttctcaagaaagcttgctcaatctttgtctggctttctctcggggatcggtttggggattatcggctatgtcccgaatgcagtccagacagcacaggcgctgattggcatcaaagcgcttctgcttctgtatccggccattgctttggcattagcgatgatcattatcggctttctttataaactcacagaccagcagcatgctcagatcgttcaggatcttcagcaaaagatctgacaatataatatagagaatatttaaaataatttataaataaaatgtgtttgtagggggttcgctaggagagtgcccaaaaaactgaaaaggaaggaggcacttgcttgaaaacgataacaattgcagctgaagaagcaaaggaactcgttcggcaaaagctggccggtgccggtttgaatgaacgagatgctgaaaaagtagcagatgttctcgtgcacgctgatttgcgcaatgtacattcgcatggcgtgctgcgcacagaacactatgtgaacaggcttttagcgggagggatcaatcctggggcacagcctgtttttaaagaaacggggcctgtgaccggggtgcttgacggagacgatggtttcggtcatgtgaattgcgacatggcgatggaccatgcaattgacatggcgaagaaaaaaggagtcggcatggtcacggccgtaaacagcagccattgcggagcgctaagctattttgtgcaaaaagcggctgacgaaaagctgatcggaatagcaatgacgcatacagacagtatcgttgtcccgtttggggggaggactccttttttagggacaaatccgattgcttacggtgttccggctaagcataaaaaaccgtttatcctagatatggcgacatccaaagtggcttttgggaagattctgcaggcccgtgaagagggcaaagaaattcctgaaggatggggagtcgatgaaaacggagaagcagtaactgatcctgacaaggtcgtctcactttcaacattcgggggcccgaaaggctatggactatcgattgtggtggatgtattttcaggattgctggcgggcgcggcttttggccctcatattgccaaaatgtacagcggccttgatcaaaaaagaaagctggggcattacgtttgcgcgatcaatccagccttttttactgactgggatacgtttttagagcagatggatgccatgattgatgaactgcagcaatcaccgccggctgttggattcgaaagagtgtatgtgcccggcgagatcgagcagctgcatgaagaaagaaataagaaaaacggaatttctatcgctcggagcgtgtatgaattcttaaaaagcaggtgagtaaaatgaaagcggttcaagtgcgaaaagcgtatgatctggtgacagcggaggtgaagaagccagttctttcaaaggatgatgaagtgctcgtgaaagtcaagcgagtcggcatttgcggttcagacatgcacatttatcatggaacgaatccgcttgctaccctcccgagagttatcggacacgaggtaacgggacaagtggaggcagttggtgcgaatgtacagagcttaaaacccggtgatcatgtggtgattgagccgatttcttattgcggatcgtgctatgcctgccgcaaagggcggccgaatgtttgcgccaagctttctgtatttggcgtacatgaggacggaggcatgcgggaatatattgtgcttccggaaaggcagcttcactcggtctcaaaggacttgccttgggaggaagcagtcatggccgagccttatacgataggcgcccaggcagtgtggagaggccaggtggaaaaaggtgataccgtcctgatccagggagcggggcccatcgggatctgtgtgttgaaaatggcaaagctggcgggcgctgctgtcatgatgactgacttgaacaacgagcggctggcatttgcgaaagaaaacggcgccgatgctgttgtaaatgtccaagcagaacatgttgccgagcgtgtccttgaatggactgggaatgaaggagcaaacgtggtcattgatgctgtttgcctgccggagacatttgcgctttcaattgaggccgtgtcaccggcgggacatgtggttgtgcttggatttgatgaaagagcggctcagatttctcagctgccgattacaaaaaagaagtcacgataaccggatcccgattgcagaccaatcagtttccaaaagtggtagagcttttgaatagaggccggttagtgcataacgggctggtgacccatacattttcagttgatgacgttcatcatgcatttcagtttattaaggagcatccagatcaggtgcggaaagccgtcatcacgtttgattaaatgactgaatccggaggtgcgagcatgaatatgacattccgatggtatggacgaggcaacgatacagtcacacttgaacacgtgaagcaaattcccggagtcaaaggcatcgtttgggctctccatcaaaagcctgtcggcgacgtgtgggaaaaagaagaaatcagagccgagaccgaatatattcaatcctatggttttcatgctgaagttgtagaaagcgtgaatgttcacgaagcgattaaacttgggaacgaagaacgcggccggtatattgaaaactacaaacaaacgatccgcaaccttgccggatttggtgtgaaagtgatctgctataattttatgccggtttttgactggacacgcacggacatgttccggccgctagaagatggatcgaccgctctgttttttgaaaaggccaaggtggtaagccttgatcctcaagagctgattcggacggtggaggaagcatctgacatgacactgccggggtgggagcccgaaaaattggtgcggatcaaagagctttttgctgcctacagaacggtcgatgaagaaaagctatgggacaatttatcattctttttgcaggaaattcttcctgttgctgaggcctatggtgttcaaatggccattcatccggatgacccgccgtggccgattttcggactgccgcgcattatcacaggagaggcaagctataagaaactgcgggccatatcagattcaccgtctaattgtatcaccctttgtacaggttcaatgggagccaatcccgctaacgacatggtggagatcgctaaaacgtatgccggcatcgctccattttcacatattcgcaatgtgaaaatttatgagaatggcgattttattgaaacatctcatttaacaaaggatggttcgatcaacattcaaggcgtgatggaagaactgcataagcaggattacgaaggatatgtcagaccggatcatgggcgccatctttggggcgagcaatgccgcccgggatatggcttatacgatcgggcacttggcatcatgtatttgaacgggctgtgggacgcctatgaagcaatggcaaaaaaagaggtggacgtatgatcccgctgcatgagaacctggctggtaaaacggctgtcatcactggcggcagcggcgtgctttgctctgcgatggcacgggagctagcccgtcatggcatgaaggtggcgatattgaatcggacggctgaaaaaggccaagcggtcgtgaaggagataacggcggctggcggcacagcgtgcgctgttgctgcggatgtgctggacaggatgtcactggagcgggcaaaggaagacatccttggccaatttggcgctgttgatctgttaattaacggggctggcggcaatcatcctgccgcgataaccgatgtggagacatatgaagaagcgggagaaggccaatccttttttaatatggatgagaggggctttctaactgtattctccaccaatttcaccggtgcgtttctggcctcgcaagtgtttggaaaagagctgctgaaagccgattcaccggcgattatcaatctttcttcgatgagtgcttattcacctatgacgaaggttccggcatacagtgccgccaaagcatcgatcaataattttacgatgtggatggctgttcattttgccgaaaccgggctgcgggtcaatgcgattgccccaggcttctttctgacaaaacaaaatcatgatctgctgatcaaccaagacggaacgttcaccagccgatctcacaaaattattgcgggaacaccgatgaagcgcttcggaaaacccgaggatttgctcggtacgcttctttggctggcggatgaatcctattccggttttgtcactgggatcaccgttcctgtcgatggaggatttatggcttattcaggtgtgtaacgaaagcgatgcaacagaaactgaaccaacataggggtgaggttgagatgttttcaaaagataagcttcccgttatcctttttttgttcctggcaggggtgattaattacctggatcgctcggcgctttccattgcagctccttttattcaggatgatctcacattgtctgcaacgcaattgggcttgattttcagcagtttttcgattggttatgcgatttttaactttcttgggggcgtggcatccgaccgctatggggcaaagctgaccttgtttgtcgcgatggttgtttggtcgctgtttagcggagcagtcgcccttgcttttggctttgtcagtctgctgattatacgcattctcttcggaatgggagaaggcccgctttcggcgaccatcaacaagatggtgaacaactggttcccgccgacccagcgggcgtctgttatcggtgtaaccaacagcggcacgccgctcgggggagccatttccggcccgatagtcggcatgatcgcagtggcgtttagctggaaggtatccttcgttctcattatgattattggattgatatgggcagtgctctggttcaagtttgtcaaagaaaagccgcaagagacgatgaaggaagcaccggcaataaaagcagaaacgtctcccggagaaaaaattccgctcaccttttacctgaagcaaaaaacggtcctgttcacggcgttcgcttttttcgcttacaactacatcctcttcttctttttgacatggtttccgagctatcttgtcgacgagcggggattaagtgttgaatcgatgagtgtcattacggtcatcccgtggattttaggctttatcgggctggctgcggggggatttgtttctgactatgtgtacaaaaaaacggcccgaaaaggtgtgctgttctcgcgcaaggttgtgcttgtcacgtgtttgttttcatcagctgtcctgattggttttgccgggcttgtggcaacgactgcaggggctgtcacactggtcgctttgtcagtattttttctatatttaacaggtgctatctattgggctgtcattcaagatgtggttgatcaaaacaatgtcggttctgttggcggcttcatgcatttcctcgccaacacggcaggaattatcggcccggctttaaccggatttattgttgaccaaacaggcacgttttctggagcatttttgcttgccggagggctggctgtcttcgcttcacttgctgtgattcgttttgtccgtccaatcattggcaagccagcggaaacagaagctgagaatcctgtgtcttattaatctggaaatatagtgggagaggcggtatgtttgatgatacaatatacagtaaataatcgcagccggtatgataaggaagggaattagatggtaaccataaaagatatcgcaaaactcgcaaacgtatcccacacaaccgtttccagagcactcaacaacagtccttacatcaaagaacatacgaagaaaaagatactagagctagcagagcagctcaactatacaccaaatgtaaatgcgaaaagtctggcgatgcaaaagtcgcatacgatcgggctgttctttacaagcattacaaacggaacttcacacagcttctttgcagacacaatcaaaggcgtcaatcaagccataagtgaggattacaatctgtatgtgcgcggcattgatgatctgaaaaactatgactccgttacaccgatgagatatgacggcatcattttaatgagccaaagtgacattgataattctttcatttaccatattcgcgaaaaaaacattccgcttgtcgtgctgaatcgtgatattgatgatcgcaccatcacgaatattttgtccaatgacaaggaaggctctcaagaagctgtagaatacttcattcagtccggccatcaagacatcgccatcatcgaggggatcgaaggctttaaatcctcccagcagcgaaaggaaggctacttatctgcactgattcaacatcatattccgatcaagcatgaatacagtgtcaaaggacagtacgatatggaaagcggctttcaagcgatggagaggctgctggcactgccgaatcctccaaccgctgttttttgttcgaatgatgacatggcaatcggagcgatgaatgcgatattcgcaaagggcctgcgcgttcctgatgatatttcggtgatcgggtttgatgatattgggttttcacagtacatcacgccaagacttacaacagtaaagcgcccagtggagaaaatcagcgtgctcggtgcgcaaaaactcttgtctctgatcagcgagcccgaaacaaaagcagaaaaaatcttggaaaacacaaaattcatggtgcgtgattcagtcagacgattgacgacgtgatgccccgtttttcagcgggcattcttttataaagaaaaatgttaacgtgtgcataaaaagagggaggcaataagatgcagaaactgaataaaaatgtgtacgatcactatactcggtatccagaaaaaattctccaattcggagaaggaaactttcttcggggatttgttgattggcagattgatcaattgaatcaacacgctaattttaatgggagcgtggcagttgtccagccaagaggctcagaaaaaatcaaacgattaaatcagcaagatggattatatacgctttttttacaaggaatgaaagacggagaagccgtaaacgagcatatgattatcaactcaatcagccggggaattgacctgttttctgattatgaagcatacaaagaattggcatcaagcgaaaggcttcggtttattatctccaacaccactgaggctgggattgtatgtgatgaaaaagatcgtttagaggataggccgcaaaaaacattccctgggaaattaactgcatttctctacttccgctttcaggcttttaaaggagatcagacaaaagggtgtgtcctaatcccatgtgaactgattgagaacaacggcgaaaagctgaaggaaacggttcttcattatgcaggtctgtggaagctggaggaaggatttacacagtggattcatgaggccaatacattttgtaatagtttagtagaccggattgttccgggttttcccgtcgacagcattgatgagatcacggcggatcttggctatcaggatgatttgatagttgtgggagagcaatattatttatgggttatcgaggggcctgattggattggaaaagaacttccctttgcggctgcagggctccatacaaagatcgtcagcgacctcaccccataccggactaaaaaagtaaggattttaaatggcgctcatacagcaatgacgccagtggctttattatacggcttaaaaactgttagggatgctgtcgagcatccggaagttgggcgatttataagagagctgattgacgacgaaattcttcctgttttaaaaatggaaggtctttctcagtatgctgacgatgtgctgaaccgttttaaaaacccgtatattaagcattacctggaaagcattgcattgagctccgtttccaaattcaaaacgagaaacctgccgactcttaaggaatatgctgaacaaaagggacagcttcctgaacgcttggtgttttctttcagcgctcttctgtatttttatcataataatgagacattgcaggatgatccggcagtgcttcaatttttcaaagaggtttggtgtcaggaggatgacgacatgcttcggattgcatcaagagtgttaggcgaacagcggctgtggggggcagatctcaatgagataccgaagctgactgatagagtcgctgtttacttgaatcttattcatgagctgggcatgcagcgggctcttgaacaatactgcatacaagagggagaggtacgttgaagtcgtttataaagattcataagcaagataatatccttcttgctctgcgggatatccaaaagggagagaggctgcatgcggacggcgtgtcgattgaagtaaagaatgatataaaaagaggccataagattgcattgcagtctatcaaagaaaacgacagcatcatcaagtacgggtttccaatcggtcatgcatcacaagatatctcgatcggagagcatattcatgtccataatacgaaaacaaacctgtctgatatccaatcatacagctatacaccgagatttgatgaaaatccgtattctaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatatcgctccatttgataacgtactggtgttaaagcatcaatacggatgctcgcagcttggcgatgatcacgaaaatacgaagcaaatcctgctgaatgccattcgccatccaaatgccggcggcgtcttggtgttagggcttggctgtgaaaacaatgagctggcaagaatgaaggaagcactgcaagatgtgaacctggagcgggtgaagtttctggaatcccagtcggtgaccgacgaaatggaggcaggtgttgctttgctgaaggaaattcatgaagcggccaaaggagataagagagaagacattccgctgtctgaactgaagatcgggctgaaatgcggaggttcggacggtttttccggcataaccgcaaacccgctgcttggacgtttttcagattatctcattgcacagggagggagcacggtgctgacggaagtaccggaaatgttcggcgcagaaaccatcctgatgcagcgggctgccaatgaagaagtgtttcataagatagtcgatttaatcaatgatttcaaacaatactttattaaacatgatcagccggtgtacgaaaatccctcaccgggcaacaaagcgggcggcatttctacacttgaggataaatcgctgggctgtacgcaaaaagcggggatttctcctgtcacggatgtcttgaaatacggggaagtgctcaagacaagagggctgacgcttttgagcgcgccaggcaatgatttgatcgcctcctccgcattggcggcggccggctgccaaattgtcctctttacaacggggagaggcacgccgtttggcagctttgtcccgacggtgaaagtagcgacaaacaccgagctgtatgaagcgaagccgcattggattgattttaacgcaggccttttagcagaggatgatgttcatgaggaatatgtgctgcgtgagtttatccactatatggttgaggtggcaagcggccagcttgtgaaccatgaaaaaaatgatttcagagaactcgccatttttaaatcgggtgtgacgctataataagaaaaggctatccttcaagcggatagccttcttcattaaatcaattttaaaccgctgactaaaataatggacgccataataaattgcagcggacgcggggagaatcgaggcgaaagatggcttccgatcagcacgccgggaattgaaccaatgagcagattagctgccagcatgtaatccacgcttccgaagctagcgttcaaaatgcctgctgccgtaacaagaagaaatgcatgcgcgatatcggttccgacaatctgtgacgctttcatgttaaataagtaaatcatggcgattgcaaataatgagccagaaccgattgatgttaagccgacgataaacccaaacacaacaccaataagaatcgtcagcgcccgcttattttcaagcggcatcagctgccagcggttgggacgaagttttctatccaaaaacaaacgaacgatgattgaaatggcaaccagcgttaacacatatcctagagcgtgcttaataatttcttcctgatgctggtgaaaggcggggaacaaatgcaagatgccaatggctagcgaagcactcggaatactgccgatggctaagtattttaccaatttaaagttaatcgttttctgccgccaatgggaggcaacgccaaacagctttgtgatcgagttatatacaagatctgtaccgaccgcgatggaaggattaattccaagcacaattaaaaggggagttaataaggccgctccacccactcccgtcaatccgactaaggctccgacaaacaaacccatcaatatgatgcttacactcatgataaaggcctcctgaaaacccgactatttttatcagattatatatgattaggacgcgttaatcaattaaattttttgaatttttgtacgttagctgcttgaaattttggtatgctcaatatctctattcatttgccctataatgagtgtctggacgagaagtactaaaggcgcaaaaaaaagatacctcttaacaggtatcttttttcttgtttacgctacatgcgctgctgatagaaaggaagctcagtgtggcccatttcccgcacatacacgaacaggttgcctttatggtgaatttcatgctccattgcaagctgaagcagcgcgcggcctgtgacttttctgccgaaagcggatgtcagatcaatttctctgtccagctgctcttcagtcagctgttcaaggatagcggccgttttttctgtatatgtttttgccagaacattgagatctgtttctgtttcttcctgcttgttttgaaaaggtgaggcattgccttctttaatgacatttgcgaacaagtggaaagacgtaagaatgtgtttgaccagctcttctgctgacattgatgtttctgccggtttgtagctgtaatggtctttgctgattttttcggcaagctcattggtcacgtttcgatgggataaaaaatggctgacaatttgattggattggctcattatgatctcctccatatgtaaaaataaatggtgcaatgaaatcctatatcaacggttatgaattcacaagtaatatgctgtgggatgaaacaaaatgctatgtcaatcgtatatataacgttcacaaaacatgaaatggagtataaacatgactaacatacctttcatttatcagtacgaagaaaaagagaatgaaagagctgcggcgggctacggcactttcggttaccttatcacacggattgaagaaacgctttatgatcaatacggtgtattctatgagctctatgccagtgatgatccaaatacggaatactgggagcttcttgtagaagatgtccgcagcggttcattggagcctgagcatgtggcatatatatttgaaaagcttgaaaagaaaacctttgcttacgatgaagatgagaaagaaccggattataccgtccataagtctataagaaacagtgtatacgcgtatcctgaaaagggagttgcttttgccagaattccatattttcaagatgggagcattatgagttttgattgtctgtttgcggttaacgatgaaaagatgcgtgcatttctggagggagtcagaccgcgtctttgggaaaaaagcaagcggaaagtgaccgtgtttacggatggagatggagggacttcaagagagcaggaagccattgtcagagaggttcagcggagtcaagtcatcatgaatccgctattgaaaaaggagatatacagatcaattgatcagttttttcatagtgataaatcgttttatcaaacatatgacatcccttacaagcgcggcattctgttatatggacctcctggaaacggaaagacgacgttagtgaagtcgatcgcaggcagtatcgatgcacctgttgcttattggcaaattactgaatttacgtcgagcgagacaatagaagaagtctttcaggcagcgagacgcctcgctcctgcagttctggtcatcgaggatatagattcgatgccggaagatgtgcggtccttttttctcaatacgctggacggcgcgacatcaaaagaggggctatttctcatcggtacgacaaactatcccgaagagatcgatccaggtttgatgaatcgtgcagggcgatttgaccgtgcctatgaaatcgggcttccggatgaagagctgcggctggaatatatgaaaatgagaggctttggcatctttttgagtgaaggagaaataaaaaacgccgcaaaacttacagaaggcttttcctttgcacagctgggagaattatatgtatcttcagcccttcaatggcaccaagaagggaatcaccatattgaaaccatggtgaaagacatgacaggagagcaaagaaaaagccagcggggaagctggatggaaagaaacaaagtcggttttcactaaaagaaagcacgggtgtttgaaaaacccgtgcttttttgttgcggttagccgaaattcgacaattgcggttattttgcgttcttctttttcttgtaaatatgataaaatatgacatatctcgggtaattcaaaaggggggattaattgaggatgaagcagacgattccgtcctcttatgtcgggcttaaaattaatgaatggtatactcatatccggcagttccacgtcgctgaagccgaacgggtcaagctcgaagtagaaagagaaattgaggatatggaagaagaccaagatttgctgctgtattattctttaatggagttcaggcatcgtgtcatgctggattacattaagccttttggagaggacacgtcgcagctagagttttcagaattattagaagacatcgaagggaatcagtacaagctgacagggcttctcgaatattactttaatttttttcgaggaatgtatgaatttaagcagaagatgtttgtcagtgccatgatgtattataaacgggcagaaaagaatcttgccctcgtctcggatgatattgagaaagccgagtttgcttttaaaatggctgagattttttacaatttaaaacaaacctatgtttcgatgagctacgccgttcaggcattagaaacataccaaatgtatgaaacgtacaccgtccgcagaatccaatgtgaattcgttattgcaggtaattatgatgatatgcagtatccagaaagagcattgccccacttagaactggctttagatcttgcaaagaaggaaggcaatccccgcctgatcagttccgccctatataatctcggaaactgctatgagaaaatgggtgaactgcaaaaggcagccgaatactttgagaaatctgtttctatttgcaagtcggaaaagttcgataatcttccgcattctatctactctttaacacaagttctgtataaacaaaaaaatgacgccgaagcgcaaaaaaagtatcgtgaaggattggaaatcgcccgtcaatacagtgatgaattattcgtggagctttttcaatttttacatgcgttatacggaaaaaacattgacacagaatcggtctcacacacctttcaatttcttgaagaacatatgctgtatccttatattgaagagctggcgcatgatgctgcccaattctatatagaaaacggacagcccgaaaaagcactttcattttatgagaaaatggtgcacgcacaaaaacaaatccagagaggagattgtttatatgaaatctaaatggatgtcaggtttgttgctcgttgcggtcgggttcagctttactcaggtgatggttcatgcaggtgaaacagcaaacacagaagggaaaacatttcatattgcggcacgcaatcaaacatgatgcataaaaaaagacccttaggggtcttttttatttcttcagcttccattcttttatcgtcagctcagaagatccacttgccaccagcggatccgcatggccgctctttcagtgaatctgcttcgatgacatacgctccgcctgtggcgtcgctgaatggcccaaacatttttaatcgtttttctgcttgtaaacgatccagaaattcatagtgcccagccacatgctcctgattaaatttctccgttctcattgtcagcattaaatatgtatacatattcagaccctccgtgaacttcagtttaacacatttatccatattacggtgatagatgatatgagtttttcgtcctacgaatgccacctatttatgaaaaaagaaaaggagagatgataggtgagcattccagtaaagaaaaatttggtttctgaggcgaaatacgcgttgaagtgtcctaatgcaatgtccgctgaatacattaccatccacaatacagcaaacgacgcgtcagctgccaatgagatcagctatatgatcgggaatacaagctcgacaagctttcattttgccgttgatgacaaagaggttattcaagggctaccgttaaatcgaaacgcatggcacacaggagacggcacaaacggtccgggaaaccgcaaatcaatcggcgttgagatttgctacagcaaatcgggaggcccgaagtatgaggcagctgaagccttggcgatttcatttgttgcacagcttttgaaggagcgcggctggggcatcgatcgtgtgagaaagcaccaggactggaacggaaagtattgcccgcaccgcattttatcagaggggcgctgggatcaagtgaaggcggcaattgaaaaggaattaaacgggggcttatcagctaaaaaagctgcagtctcttcttcagcgtctgtatatcatgtgaaaaaaggcgacacattgtcagggattgccgcatcacacggagtcagtgtgaaaacgctgcaaagcatcaatcatattactgacccgaattacattaaagtcggacaagtgatcaaactgcctcagacggcatctgcttctaaaagccatgccgcatcctcatatccgctcccatccggcgtgatcaaagtgacaagcccgctgacgaaagggacaaaagtaaagcaggtgcagaccgctttagccgctctttatttttatcctgataaaggagcgaaaaatcacggcgttgacggcgtttatggcccgaaaacagcaaatgcagtgaaacgttttcagtctgtcagcggtttaacggctgatgggatttacggtccgaaaacgaaagcgaagctggaggaaaagctgtaaatgaaaagacggaagctgtgaagcttccgtctttttatcttacatacaaactgcggcaagcaccttttgaatatcataaatgctctcatcttttttaaactgctttgagacggcaggaagctctgcgccggagatccaaattttcagctctgaatcgaggtcaaagcggccggccgtttccacgctgaatctggaaatgcttttgtacggaatcgattgaaactccgttttcttgcctgtgattccctgcttgtccacaagaataagccgcttgtcagtgaagacaatcaaatcgcgaaccagcttaaacgcggcttcaaccttctcaccctcaagtaaaatatgagcaagctcttcttttacagcagccgttgacagtgttgacgcattgccgagtaatccatcaataaaccccatcatatacctcctctgcgtattctatcaaatcatactataaaaaaggttttcattcatagatgagtagagtaaactggtgctgactggtaaagggggcgttcaaaatgaaagatatgtatgacagctttgcagccctttctgcttctgagtcggagtaccggattatttatgaggagaaaaacggaagtgagcttatcgtcctcggtccccacggcggcagaattgagcctggcgtcagtgaattggtgcgggcattttcggatcgatgctccatctatttgtttgagggtgtaaaacagcgaaacaatcgttccttgcatctcaccagcattcgttttgatgagccgctggctttagaaaaagtgaatgcccaccattacgcattagcgtttcacgggtattatgatccaaacatcccgcatactttggtcggcggggctgatcgaaaaaaagccaagctcatttgtgagcgtctgaatgaagcgggttttagcgccgagctaactaatgagaaagaccgcctggcaggtgtacacccaagcaatattgtcaatcggacgaaaagagaaatggggctgcaattggaggtgagcacggcacaaagaaacgcgctgttctgcaattttgggtgccgtgataaaagctacatacaaaacgacttgtttgatcgatatgtggaagccgtcaagcttggcttttatacataaaacgaaacgggacctgcactgtcagcctattccttcatacgctgggattgtgcgaaagtgtagggaggaatgattcatgttttatcatataaaagagcttcaatatcaagcaaagccagctcatcccgatccggtttatgcgaaaaaacttcaagaggtgctcggcggccaattcggtgaaattagcgtcatgatgcagtatttgtttcaagggtttaactgcagggcggatgctaagtataaagatttgttatatgatgtggggaccgaagagatcgggcacgtagaaatgctggcaacgatgatttccaggcttctggacaatgcacccgcggatgtacaggaggatgcttataaaagcaatccagctatcgcagcagtcatgtccgggatgaatcctcagcacgcgattgtgtccggattgggggcgatggcatcagatagtgagggctatccgtggaatgcaaaatacattatctcaagcggaaacctgctggccgattttcgcgctaacttaaatgcggaggcccaaggacgccttcaggtgacacggctttatgccatgaccgatgatccaggggtaagagatatgctgtcatttttgattgcaagggatacctatcatcaaaatatgtggtacgcggccattaaagaactggaggaaagagaacgggatattgtcgtcccgacgacgttcccgcgtgagctcgaaaagcaagaagtctcctatgatttgtttaacttttccaggggggatgaaagctcgcaaggaagatgggcacatggggaagcctttgacggccggggtgaattcaggtatatcccggctccgattgcgttcgcatctgcgcctcatcttaaaccggcgcccatgtggctgcataatacagttcccccaatgtcgaaatgttaggttctcttctgggctgaggaatatatccttagcccgtatttgatcagatgtttttgccaatatgatataacgctttttcctcagcgacctgcaagtgctgctgatcgccttcctcgtacgcatttggccgcttgtgagataataaataagcgagccgcttctgaaattgaatacctgctttacgccgttcaaacatgtcaagccttttatcagcaaattcctttgttacccggaataccgccgcaattgtggcgagtgcctggcttctccattgcggcagttccatctgcaacagcataaaggttggcacacagaagtggtacataaattgatttgcctggaattcttgaagctctctgaagagcttgttcatctgaaaatgattgcctgcatgctttaacacgtggcacagctcatggccaaaatcctcccattgctcttcccgtgactttttttggttcaatacgatactgtacatgccgtcgtatttcaccatcatgctccccatatcctcaaaatgcacccaaatatccagatcctttgcgattttcagcatgtcaatgtgatgaggggatgtgatgcccagccggccgtataaatttttaacgtattcctccagatgtgataagtaatcgcccaattgaatactccctttcgaacgtttgttctgtttttagcgagaaagaaaagcccgtataggactggaaagtagtgtagaaatctttcccttttctttaaaaaataaacacttttttctttatatcggtctactttttatatgttttagagaacagagaacgatttatttatttttcggtttgcggtttttctctttttcttttaaatagttgataaattcgatggcctgctgtttgctttctggggaaaaatcctgcatatcgcggtatgcaagctgcaggtccggatctgagaacatatcgtcatcggattttttgtcttttcccgttaataagtaatcagtcgttacttgaaagtaatcagccagcttttggagtgtgtcgtaatcaggttcgcttcgcccattttcatagtgggaatatcgtgcccgtgacacaccgatgtgtgatgcgatttcttcctgtgtccttttccctctgagactcttcaatctgccgcctatcatactatgacctctcttttttaaactccctacgttacttatgattatagatacaatatgtatcaaaataaagttatgataaaaaaagtatcaaaaataacttgatgatacagttcgtatcgtttatacttggtaacagttgatacgaaatgtatcgaaaacaaaccaggagagtgatcacatgtatccaatccaaattgtttttagtgaaaatcccatagatcagcgccatctcggacaatccggcggcaccatttcgtttacggcatgcggccttccggtgttccactttgaaacgcaagagcagtttcaagcatacatgatgttaaagggagaagcggcgtacaatgaaaaacgataaaagctatccttttccgacgtattcagggttattgaattcagaacattatgacaaaatgggcccggcgctatggttgtttctctggtttatcagctcaacaacaaaagaaatcgaaaaagacggggtaagctggggcatcgtactcggccataagccgttaaaagcgagagaaatggcggcagtcttcggcgtaagtgaaaaaaccgtcagaagatggctggagcttctcgaaaaccatgattacataaaggccgtccgtgcgccatacggactgatgatttcggtcaagcattccaaaaaattcagcttcagatcggacaatactgtacacgggagtctaaaagaacggccattttcgccgcagacaccggacacaaacgaccgtacagatatagataaaacaaacaaatatactgctgctgatgatgcagtggatcacattgcgaagcggtttacacaattacggtcggctcaagaaggacgcaccgtgtatccttcctcaagagattatcaagccatcgcccgcattgttgccatcggcgttcctgtcatgcaaacaatcaaatggcttgaagaatgctttcagacttttgaaaaccggcggaccgccgcttctgaaacaatcaaggcttttcgctactgctcgaaattcattgaagacagatttttcgcgcagcaagccaaaaagaatgccgcaattcagcatgagaggatgaaaaaacatgacaaaacgaacaatcgaacagattttggacgagctgagaagagggagacgtccattactggcggacaaaccggccgaatcagacgcaagcaggtatgattgcctgcgctgcaaggatcagggaggttatctcgtcaggcagaatggcctggaagtctggacgatgtgcagctgcatggcagaacggaaagtgaagcggctgctgggtgcaagtgagattacccacgctttcagacagctcggcttcaaggaattccgcacggagggaaagccgcaggccataaaagacgcatttgagtgtataaaagagtatgttgccgattatgaacaaatcaaggattgccgaaaaaacagcattgcccttttaggacagcccggatcagggaaaacacaccttttgactgccgctgccaacgaattaatgagaacatgctatgtgcctgtcatttattttccgttcgtggaaggctttactgatctgaaaaatgattttgccctattagaagcgaagctgaaccggatgaagcaggcggatgtgctgttcatagatgacctgtttaaaccggttaacggcaaaccccgcgctacagattggcaattagagcaaatgtattcggtactcaattatcgctacttaaatcataaaccgattttgctttcgagcgagctgacaattgaaggacttgtacgggtcgatgaagcgctcggcacgagaatctatgagatgtgcagtgactatttagtgattatcaaaggagcagcctacgagcttaaccatagattggagggcgtcagataatgtgtaagctttgtcaaacaaagaaagtcattgtggaacataccggtattggagtcgtttttcatccatgtccgaactgccggtccggcactgacttaacgcctgtcattcaaaagctggagcaaatgctgacagcgggaaaaacgaggctgaatatctatgattaaacagctgactgcactaatcgctttgctgtttcgagcaaagcgaacagaaaaaaacattgaacaatggtataaggacgacgggaagtgaaagtgttggcaaagacaaaacaggcagagaaaagccctgcgccgtggcgtgctgtcccgtgcggggatacgaaaccgatctatatttattcagcttacagtgaagaagaaaaagaaagatttccgtactcaaacgggcggctgattgcagctgtatttgacctcagctcttattcgcaaaaaagcaatgccgttttgatggccgctgcgcctgaattgctggaagcgtctaaagcagcacttgattttctgaaagggaattctgttcattcaaaggagcgcatcattcagctattagaaaaagctgaagcaagcgctgcaccgaaaaggggaggaaaagaaacatgattcatcctaaaaaactgctgcatatcgattccatcacgcttaagagccagctggaggaagggaaaatccgtgtcattattgtggatggcatcaagcaagaagcatggatcacagaagcgcccgagcatggaaaaacgctcgtcgaaacaagaaagggcgatcttgcccgtgtggaatttgaaatcggctacaaattaaattaaagcgaaaacagaatacgtccaagacggaaagcctgcggacactgatcaactgcacagcatttgtgcgttgattggtgtccgttttttatttgccaaaaatgaggaggatcatagaatgcaagacttactatttgaatataaacgcacgctcaaacaaacaagaatacaatataaaccgctcgctgaggcagatgaatccgtgctctcagctgaagagctgaaggataaaaaaatcatcagaaatatgattactgatcttgaatatgtaacagaatggcttgaaaaaggaaggcagcccggcatcagacgggcgattgaccggcgtgatgcctaccagcggctgatgatcaaggacccgagaatcatcgaatcattttccagcgctatgatgtttgagccggacggacaggtatcagaagaagacagagagagaattcgagaagcattagccctgttaacggacagagaaaaggaaatgtttttgctgcataaggtagaatgtttttcttatgaacggatcgccgatcttctcggcgtaaaaaaatcgacagtgcaaacgacgattaaacgggcgagtttaaagatgcaaagacagcaggaagaaatgaatcgatcacttgcctgaaagcttgtcatacgtttgccacctataagtgaatagagcatgacactaagcggctggctgatcagccgcttttatgaataaacaaccatgctggaggtggcggtgatgcagtagcatgaaaacacaacagcgcgaacaagcattagcaatctatcaacaacatcaaggaaagatcacaaatcgggcgattgcggacacaatcggtgtttccgcgaaaacaatcggcatctggaaaaaacaagacaaatggaaagaggcgctgttttctgcgtccaaaaacgaacaaaaacagcgccctataaacaacgatgaattaaatgaacgccagcggctgttttgcctgtattacgtcaaaagcttcaatgccacacagtcagcaatcaaagcgggctattctccggacagcgctcatgtgacgggcagccgactcttaaaaaacgaaaaggtcgctgctgaaattagacgcattaaaaaagaaatggtcaatgaaatgtttattgaagcgatggatgtgctgcaggtttatatcaagatcgcgtttgcggatattacggactatgtgacctttggaaaaaaagaggtccaggctgtcgggaaatcgggtccgctgtttgatgaagatgataatccgattatgaaggaaatcagctttgtcgatgtcaaagactccgggctcgttgatggcaccattgtaacggaagcaaagcttgggaaagaaggcattgccatcaagcttgcagataaaatgaaggcgcttgagaagctatccttatattttgatttgtttccagatcaatttaaacaaaaaattgaaaatgagaaattgaagcttgccaaacaaaaagcggagaaaacagatgacagccaggagccgattgaaattatgatcaaacgaaaagagcgcaagtcatgattgtaaaagaaatcaaccctcatttcgaagattacgtgttcaattgggagcagacgtaccagtttcttgtcggcggctacggctcatccaaaagctatcataccgcattgaaaatcgtgctaaagctgctgaaggaaaaacggacggcccttgtgatccgggaggtgttcgatacccatcgggattcgaccttcgccttgtttcaagaggtgatcgaagagctcggtctcacaaaggccgtggcatctctttcttccccgctgcagctgcgatttcacaatggcagccggatcatgttcaaaggaatggacaatccggcaaaattaaaatcggttcataacatttcattaatatggattgaagagtgctcagaggtgaagtatgaggggttcaaggagttaatcggacgtcttcgccatcctgagctaaagcttcatatgatctgtaccaccaatcccgtcggcacctccaattggacgtataggcatttttttcgggatgaacgcaagaaacggtttgtgctggatgacagcgaactttacgaaaagcggacgattgtaaagggagatacgtattaccatcattccaccgctaacgacaatctttttctcccggaaagctatctgaaacagcttgacggactcaaagagtatgatcccgacctgtaccgaattgcccgcaaaggacgattcggcgtcaatgggatcagggtgctgccgcagttcgaggtactcccgcataatcaaatgaaaaaatgtatcgcagccatcagcaagccaatctttcgtacaggcatggattttggattcgaggaatcctataatgccgtcgtccggcttgctgtagatcctgaaaaaaaatacctctacatttattgggagtattatcaaaacaaaatgacagatgacaggacggctgaggagctgcgtgagtttattgagacacaggaattgatcaaagccgactcggctgagccgaaaagcattcaatatttccgccagcagggctttcggatggttggagccagaaagtttcccggctccaggcttcaatataccaaaaaggtaaaacggttcaaaaaaatcttctgttcggatcgctgtgaaaatgtcatctatgagctcaagacacttacgtatgccaaagataaaaacggagctctgattgaggatgaattcacgattgacccgcatacgctttctgccatttggtatgcgcttgatgattatgaggttgctgatatgaaagagacagcacacaaacgaatccggccgaacagagaaaggaggaggtcataaatcatgcacaatcaaacagtcagagcaactgtatttaaagccaatgccgcggctccacaaacaaagcaaatctatgaagatgacttttctgagctgtacggagaggacattatcgctccgccctacaatatcatcgagctcaaaaccattgccgaatactcgaccattcttcagcaatgcattgatgcgtacagagtgaatattacaggctttggattcgatgttgagtacacatttgatgtcaacgcaagtgatgtcgatcaggcaaaaaagaaaagagcggaaaaagactgggccagactcgaagccttttataaatgtcttcactttgatgaatcagctgaaatgattttaggctatgccatcgaagacagagaaaaaacaggcaacggatttatggaagtgcttcgcgacggggcgggaaaacctgccggcatcgaatatttagatgtgaaatatatgcgtgtatgcggagcaggcgagcctgtagaggtttcattcgtatatgaagaaaacgggaaaatgaaaaggatcaaaaggcaaaaacgcttccgaaaatatgtgcagatgatcaatggaaagaaagtattttttaaagaatacggcgatccgcgaaaaatggatattcgcacaggtgaatatgtaaacacattggcagagaagtatcaagcaaatgaagccattcacctcaaaatcggaagcggcgtatacggtgtaccccgctggatcggcaatattgtcaatttatacggggcccgaaaagcagaagagctcaattttatgtattttaagcagggacgtcacgtccccgctgcgattacagtggaaaacgggatgctgtctgaagcttcttaccgggagctgcaggaatacatgaatgatcttgaaggtgttgaaaacgcccataaatttctcctgatcgaagcggaaggaatcgcaaaagaaaaggatctccacggaggcgaggatattacgccggtttccgtggaaatcaaatccttggctgaaattctccaaaacgacgccctgtttcttgaatacgatgaaaaaagcagaaataagctgcgttccgcgttccgtctcccgccgctgtatacaggcgaggcccaggaatacaaccgggcgacagctgatactgctagaaaaattacggaggagcaggtttttcagccggagcgaaaaacgctcgtgaataaactgaatacgctgcttttgccggagctgaatatccatgacgtcaggctgacattaaaaggaccggactttcgtgatccgcttgagattgcgaaggtgctcggtccttttattacagcaggagcagtctcgccgaatgatttacgcgaccttgccggacgggtgcttggcaaaacactggaggagtggccggaggacatttataaacggcctgcaggacaggatgcggaaaagacaaacctgactgcgctcatgcaggagttgaaagaaagcatcgaagatatcaaaacgtcctgaagggaggtgaatcaaacaggtggcgcgagaattaagaaatgccaaaatcagctttgtcagttatgtggacaaggcggctaaccagacagaatttttctttacgaagtcagccaaacctccgtcatttgaaaaaaaggttcggctgtttacaaaaagtgagcaggatgaacaaaagctcgtgtacggaatcgtgtatgagcctgatgttcctgatgcccacggcgattttatgaccgccgaggaaattgaaaaagcggcgcacggttttctcgcggaggcacgggagattgatatcaatcacagctttgagggcggaaccggcgtcgtggtcgagtcctatgtggcgcccgatgattttatgatcggatcaaagcggattacaaagggctcatgggtgctcgtgacaagagcgtctgatgaggtgtgggaacagattaaggctggaattatcaccggctacagcatggctggcactgcagatgtgtatgaagaagaaccggtcgaaaaagcagggttctttagtgtattcaagcaaatgcttgctgacaaaacagggaaggagactgaagaaatgagaaaagaagacatgaaagaatcattcgagcatgcgctttaccctctgctcaaacggcttgagcggattgaaaaaaacacagacacggaggaaaagccggagcagacgggtgatgacgagcgtctgaaaaagctcgttgaagacatgcttgccccgctgatcgaacgcatcgaggctttggaattagcgcgaggcgcgtctaagcagacagcggacgatacgggcggcaatacagagcaagtcaaaaaatcaatctggagcggactgctgtaaaaccagtcaaggaggaggaaatcaattgagaaatcaagagatcattcggaaagcggaaatgtcgctttctgctttaaaaagcggcgggcttatgaaccctgcgcaagcatcggcttttatccgcatggtgcaaaacacgccgaccattttcagtgaatcccgcgtgattcaaatggaaaatgactcgcaaaaatttgagaaaatcggcttcggccagcgtattctgcgggctgcgcaagaaggaaaagcactgtcaaacgacgagctgacagttccaacgacaagcactgtccagctgaacacgaaggaagtcattgcggaaattaacattacgtatgacacacttgaaaacaatattgaaaaagacggcctgcagcagacaatcatgcaaattttagcagagcgcgcagcagttgatattgaagagctgatcgttaacggtgatacagcatcagctgatccgtatctggcacagctggacggcatccgtaaacaggcggtttcccatatcgttgacatgaacggtgaagaactgtccagagcgacattcaagaaaggcttaaaggcagttccgccaaaatatttgcgcatccctcaggaattcagattctatacgtctcacggcttagaagttgaatggaaggaccgcgtggcagaccgccagacaaaccttggggaccaggctgttcagggcggcttgtcaacagcattcggcgtaccggtcaaaggagtatccaatattcagccgtacacagtcggtgagggagacgcgcaatatgacgcttctgatatcattctcacacatccgaaaaatatcattctcggcttctcccgcaatatccgaattgaagtcgacaaagacatccgctcccgtaaattcattattgtcttaacggccaagctggacagcaagttcgaggaagaggatgcctgcgcgaaattaattaacgtaaaagaataatagaaatgaggtggtcagctcatgctcattgaaccgactgacgtagcctcctattcggtctatgatcgggtgaaaaacaggccggaagagctgctggcgcaggatatcatcgaggcggaagcagaagcggctctcatcacgggccaccgctttgaagacagcttgtatgatccgctgcccggcaaggtgaagttggctttagtaaagcttgcccagtattttgcgcttgtcaacagcgatgaatctgcctcatcaagctatcagtctgagaaaatgggggattattcctacacggtttccggagaaggcggcattcagcggccagaggtatatcatttgctcgaggagtttatcacgccgggctacgcccctgaatcctccagactgaaggtgaggtctttatgagctacaggcagatgctcattcatcgctgcgacatttatcatgaagcagcgcaagcgccgtctgcaggccgatttgggattccggcagacaggctgcagccggtgatttcatatccggatacacccgatgaacaagatgtcccttgttattttaccgaaaaaacgcagcagctgattcaggaggagccggatcaaactgtatatcatagctttctcgtccattttccgttgtcagcggacatccgcgtgaacgataaaatcatttgggagaatcataaatatatactaaagctgccgaaaaggattagacatcatcattgggaggtcgtcgcagtcagggatgaaagcctatgaaaatagcgggattgaaacagctgaacacggcattaaaagaatcggcttcaggcggtttttccagacaggcgtcccggtggcttgaggagtgcgggcaagattttctcgagatcgtccaatctgaactcatcagcacacaaacgattgatacagaaaaactgctcatttcctttgagaaaggcgcagaggacaatctctggattgtgcaaagcggcgggctttcgcttgaggtggggacacagcttgattacgcctcatttcttaatgacggccattggacgtcaaaacaagatgtgagatgggtgccggggcgttttcaaggctcacagtttatttatgatccagcggcttcaacgggaatggcgctcaagagaaaatggataccgggcacgggctactgggatcatgcactgcttttatatgaacagctgtttgaaaaatcgctggaaagcaaactgcgccagtggctgaagaagctgtaaaggaggagcaggatgaacagtgaaacaggatcgatcatggcgtttttgtacagccggtggtctgttcccatttatgaacgcgagcttcctgatcactttcaggtgccgtcgttatacgtcccgccaccatctgttttcgaggaaacagatacggtctccacatttaaaaaaacctacagtctcaatgtaaaactgtttcatctggactccgttcaggcgctggatgaagcggacaggctcgcggatgccatcagagaagcgagaaatatgattccgctgctgagtgaatccggtgagaagacgggggatatggttcgcatctcccaaatcgagacaagggtaggagacaggggcgaggcggccatggtgatcaggtggagcagccgatattattatcacaaaacagaacagcctgtcttacaggatatcgacatgaacagcggggtgaaataaacggtgtcaaaggacaaacaacagaagaaggctgtacatacaaagagccgggaagctctatttgatacagcggatttgattaagcacgcgaaggaactgttcggcgttaagccggatattcttcagggggctttatttggcgtggatcaaccacgcatgacgaaatcagaagccaaccaattgattcaaacatttctaaccaaggaggtcatgtcatcatgaatggcggaacatttacaacaggcaaagaaaaagaacgtgcaggcatttattttaactttaaaacgacggcacaggagcgggtatcactcagtgaacggggaacagtcgcacttccggtcgcatcaagctggggcgaagcgaaaacgttcgtctccatttccagtgttgaagacctaaacaaaaaagtgggcctcagcatcgatgacccgtctttattgctgctgcgtgaagcgaagaaaaatgcgaaaacggtattgatgtaccgtctaaccgaaggtgtccgagcgtctgctgatattgctgaaggcgtcaaagcaactgcagtatatggcggaacaaaaggaaatgacattatcatccgcatcaatcaaaatgtgctggatgctaattctttcgatttgacaacatatatggacgaatcagaggttgataaacagactgtcaaaaaggctgaagaattaacagctaacggctatgtcacttttaccggaacaggcgatctttcttcaacgattcctctcactggatcagaaggagacactgcagctgagacgctgaatgcatccgcgggcatccgtttatctggcggtacggataaagcccctgtcaactctgactatacagatttcttagccgcggctgaaacggagagctttgatgtgattgcgctgcctgttgcagaaggtgaccagttgaaagcgacgtttgctgctttcattaaacgcctgcgcgacggccaaggacaaaaagtgcaaggcgtcacagccaattatgccggtgattatgaaggcatcatcaacgtaactgagggtgtgctgcttgaagatggcacggaagttacacccgacaaagcaacagcttgggtagctggagcgagtgcaggagcaacctttaaccaatcactcacatttgtagagtacgaaggcgccgttgatgtgttacaccgccttgaccacgatacgattgttgaacgtctgggtaaaggtgaatttttattcacattcgacgcccgtgataaatccgtcagcgtagaaaaggacattaactcactcgtgacgttcacagctgagaaaaacaagaaatttgcgaagaacaaaatcgttcgtgtcctggatgctgtgaataatgatttaacacgcgagctgaaagccttaattaaatcaagaaaaggcagcggaagcgatatcccggcatctgaagacggactgcagtatgtaaaaacgatgatcacgcaatacatgacaacacttcaggatgcaggcggcatcactggctttgattccgatgaagatatcacaatttcaatgaatgaagatcgtgacggcttcttgattgacctggctgtacagcctgtcgacgcagcagaaaaattctactttaatgtggaggtaaactaatatggcattaaaagcacaaaacacaatctcaggaaaagaaggccgcttatttctcgatggtgaggaaatggcgcacatcaaaacatttgaagcaaacgttgagaaaaacaaatccgaagtcaacattatgggccgccgcatgacaggccataaaacaacaggggcaaatggaacagggaccgcaacgttctacaaagtcacatcaaaattcgtgctattgatgatggactatgtcaaaaaaggcagcgacccttatttcacacttcaagctgtgctggatgatcaatcctcaggccggggcacagagcgagtcacgctgtacgacgtcaactttgactctgccaaaatcgcaagccttgatgtcgattcagaagcgttagaggaagaagttccatttacattcgaagacttcgacgtccctgaaaagctgtctgacacgttttaatcaaagctgaatcagcacatacgcagacctttctcagaaaggtctgttttttaaagatgaaaccaaacaatagacaagggagttttttacatgagcgagaagaacgaaaacgtatatgatctttccttttttatgccgggaaaaacaattgaagctgaggaaatcaaagtgccgatctcaaagcgttttgttgataaaaaagggaacatcgtgccatttatttttaaagcgatcacgacggagcgcattgatgaattggagaaagaaacaacaacgtataaaaatgtcaaaggcagaggccgtgtaaaagatttagacagccaacgcttttatgcccgaatcgcagttgaatcaaccgtttatccggacttccgttcaaaagagcttcgagaagcttacaaaacggctgacccggtagaagttgcgaaacgcgtgctctcagttggaggcgagtatgcgaactggttaaacaaagcgattgagattaatggatttgaagatgaattagaggatctggaagaagaagcaaaaaactaatcaaggatgggcataaagaagccgtgtatctctactatgcgatgcacgagcttcactattccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaaatcaataaataagcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacttagccggtatcaataaggataatgctggcgaaaaagtaggttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtatcaacatggtttatggacaatgtctggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagataaaaatgccacaggcggctacatcaccaaaccaaccatctcgtggatcggtgaagccggcaaggaattcgttatcccggtcgataacaaccgaggccgggggaagatgcttctttcacaagcggcgtctaagctgggtatgcaagttgtagacgacatgggagcagcttcgtcttctggcggaagtccagcatctatttcaggaggagcagctgtcagtcctttatcaggctcagcctccccagcaatgaacactgcaaatcttacaggccaagcgtccacactcggacagcaattttcagaaggctttggtaaaggcatcagcgatcagccggtcaaaatggaagactggaaaaagaaaaacatcaatacgccatttacacaaatgatttctgcttcaccaaattacggtaaacaaatggtaagcgggtatgccaagggccaaaacggcactgcaaccggaacggacggctttttgcaatcaaaagttaaaacgccgtaccaagccactatgaacaaatcgtcttcatggggcacaggaacggtcaaaggctttgcgcaaggacaaaactcaacccaaacagggactgcacagtatgtgagtacacatgttgacaaaccgttcctgcgttcaaaagacacatcgaacagctggggttcaggcatgatcggaaactttgtgacaggcatgaattctaaatccagtgaagtaaaacaagcggcaaaggatatggccaagagagtggagcaggctttccgtgaggaattagatatccattcaccttcccgtgtcatgatgagcttggggcgttttgcttcaattggtgttgtcaaaggccttggctcagtagatgtaaagaaatatgctgaaaaacaagccggatcactggcggctgcctattccggaatgggagccatgggcgggaacgtaaaacagtggattatggcnnnnnnnatggccacaaagacaccaatgagctggcttccgggtctcttgacgattgcgcagcatgaatccggaggcaatccgaacgcaatcaacctgtgggacagcaacgcaaaagcggggcatccgtcacaagggctgatgcagacgatcccaagcacttttaatgaccataaagcaccgggtatgggtaacattaaaaacccgattcacaacgctgctgccgcaatcggctacatcaaaagcagatacggctctattgacaatgtacctggtattaaaagcatgaagcatggcggaccttatgtcggttacgcaaacggcgggctgattacagaagaacaaattgcacgtgtcggtgaaggaaacaagcgggaatggatcatcccagaggaacgtggcatccgaggccgctacctccttcagagagctgcgcaagctctgggaatggaagtgacagatccgtctcacccccagcagtctgagctttctcgaggacaagtttccgctgttacttcagctagccggccaaccgcagcggtttctggatcaaaagagatttatattcaatttaacggtgaccagcatttccataatggacaagacgccgaaacccttgcggcgaaaatcaagcaggcattacttgatgaattacaaaatgacattaacaccggaacaaagggggtcgtggcttttgactaagtctatctatgaattttggatatcacaggggaaagaaaagctgcgnnnnnnnnnnnnnnnnnnnnnnnnnnnnnnnnnnnnnnnnnnnnnnnnnnnnnnnnnnnnnnnnnnnnnnttgggtgaactaacgtttattgaagaacccggagcaaaagaaatttcattttcttctttttttccaaaaaagtatacgccgatagctgaatatcaaaatctcccgtctccggaaaatgccattgcgaaaattgaaaaatggatgaaggcaaaaaagcctgttcaatttttaattacgggaacaaaaatcaatatgacatgcagtattgaaagccttaaatatagtgagggagacaatgaaataggagatcgggattttgatattgtattaaaagaatacaaaaccgcttccccgcggaaaatcaagcagaagaaaaaaacaaaggcaaaacgtccgtcgaaggctgcgccgaagacgtacacagtgaaaaagggagacacgctatgggacattgcaggcagattttacgggaacagcactcaatggcgcaaaatttggaacgccaataaaacagcaatgatcaaacgaagcaaacggaacatcaggcagccgggccactggatttttcccggccaaaaattaaagataccgcaatgaaacaggtgatgtatgatgatagaactgttcgtcattaaagacacagagtggcttgagctggttgctgaaagcgtatcgcttgaaggccaccgttatcaggcgccgcgctccattgaagcgaccatcgtcaccaaacagggcgaccagacgtattacagtgtctcagaaggagatacggtcttgtttaaatggaagggaaaagagctgtttcggggcattgtttttgcaagaaccccggacgagcatacgcttgccttcagcgcttatgacatgctgcagtacctggtcaaaaaccaggatatgtacgtgttttccaatcagcgggccgaccagatcatcagaaggattgctagtgacttccagataccgacaacctcgatcgcgaacacaggccatacgatcaaaagtcttgtcattaaaaatgatacgacattgtatgacatcatattaaaagcgctgaaacagacgaaaagccagacaggacgacattaccagctgtattcggaaaaaggaaagctcagtctgcgcgcttggccagatccgtcagaggtatgggtgcttgaaacgggcgtcaatatcacaggctaccaatacagcacttctataaacgacactgctactcgggtggtgcttcgccggcaaaaggacaataagacatataaagcctctgctaaggacagttcaggcttaaataaatacggtgtgcttcaatatacggaaacggtcacagatgacatcaaccaggcacagcttcagcagcgggcagatgtacgccttgctgaaaaaaagggcgtgaaaaaagaactgaaaaatattcaggcagtgggcatcccggaagtgcagagcggcttgcccgtctatatttcgattccagaggccggtatcaagaaaacctattgggtagatacggaccggcatgaatttaaaggaacgaaacatacgatgacgatcgatgttgtcgaaaagaatacgatgccggaaggagtatcctgatgagattaagtgaggctataaaacatttggcagtcggcgcaattgacgctgagtctccggtagaactgctcccggctgaagtcgtttcagtttctcctgtggaaatcaaattaaaagaaaacagcaaactgatcataccggaagacgccatcattatcccaaaacgaatgcagtccggaggagacgatgcactcgagctgggggatcgcctcatgaccgcggctctgactggcgggcaatcgttttttattttagataaggtatagacaaaaccgcttcagtacgaaggggtttttatttagcatgtaaaaggagtgggcatcatggccctgacaccagaagtggagtttgaagatattgaagatgagagcgaagtcattgaaacctcgcaaacgtacaaaatagattttgaaaacggaagaattacgaatgagctgattaccgggcttgaagcgatcaggcagttcgtgtatatcgccttacagacagaacgctatgcatattccatatacagccataatgtcggaaacgagcttcaggacgtgctgacagatcatgagacgactgatgcgtataaaaagatggagattccgagactgatagaagaggcgctggtttatgatgaccggatatcggctgtaacagattttgagattgaaaaacaaggcgacgcgtttcatgtgtccttcgtggtggagacggatgaaggaacgcttgagattgaggaggtgattggcgaacatgtttgaagatcagacttttgaagcgattatggagcgtatgctgaacagcatttccgcagatattgacacaagagaaggcagcgtcatttataatgcgttagccccggcggcggccgagcttgcgaagtcttatatatggctggatactgtgcttgagctcgttttttctgataccgcacaaggcgaatttttagacaggcgtgcagcggaagcgggaattgaacggacagccgcgacaaaggcggtcagagcgggagagtttacatctggagttactattcctgtcggctcccgcttttacgtggataatctttattttcaatatacggcagacgggacactcatctgtgaaacacctggtgaagcgggaaacgccaatctgaccggacgcaatttactgtcattggataccattcccggtttagaaacggccatagtcaaagaaatcctgattccgggacgcgaggaagagggagatgacagcttgcgagaacggtattttacaagggttcggcgtgaggccgtcagtgccaataaaatgcattataaagagtgggctgaggaagtggacggtgtgggaaaggcaaagatcttcccgctttggaacggtgaaggcacggtcaaaattgtcgtcacgaatgcgaatcttgagcccgcttctcctattttaattcaaaaagtgaaagattatatcgaccctgaaccagggcagggagagggacaggcgccaatcggagccgttgtcacagtggaaagcgcggtctggaaggaagttgagatttctgccgaagtgctccctgagatcaatcactcaattgatgaagtgaagtcagaaattgaggaaggcgttttgaatctctttaagaaaatggcgtttgaagataacgtcatccgcctttctcaaattaacaatatcgtctataattcaccatcagtcagtgactactccaatattcaaatcaacggcacgtctgaaaatctggtgctgagcgacgtggaaattcctaagcttgggcaggtgaagatcattgagcaaacaagatgacatgagagcttatctgccgccgtttctcaccagccttaaagaaatggctgagctgctgaaagcggaagcgcctgagtttgataaacaaaatgacagcatatttgatctgacggatcagttattcgtaccgacggcgacatgggggctcagccgctgggaaaagattttaaatgtgcctcgggaatcaggcgacacagatgagatcagacgattgcggctcatttccaaaatgtcgaacatcccgccaatcacatatagggccattgagcaggcggtaaaccgtttcttgaaaaacccgtctgcacaggtccgcctgcttcccggcgaataccgatttaacgtcgatatcaatgttgatgacctccagcacatgaatgagctgatcgaagcgatagaaaacatgaaacccgctcatttggcgtatacgctcagaggcggattgaatgagacgctgcaaatcaaagatacagtcatcctgaatcaccgcagataccgaacagccagtgagctcaaggtcggttattctgtcactcttaacaacaatgaggtggttttaacttgatttcaaccatatacagagaacgcacagcggctgatctaaaaagcagaatcgatcacgtgctgctcaacggccaaaaaacagaaatagtagagcttgccattgacggtgcgaccgtcaccgttctgacaaaacgtgaggaagacatcaagcatatcgaaacggtacaaatttttgacgagctgggcaatgtgatcacagagagaaagactgacctggacgttagcgaaaacagaacactcgatttcagatttacttttgaggtggtgtaaacatggcatacgaagaaaaaacagactggcttccggatgatcccatcaacgaagatgacgtcaatcgctgggaaaaaggcataaaagacgcccacacagacctggccgcccacaaaaacgacatgaacaacccccacaacacaacaaaggcgcaaatcgggctggggaacgtggataatgtgcagcaggcggcgaagaaggattttgaccagcatgagcaagatcaggtgcggcatatcacatcgacagagcgtgaaaactggaacgcaaaagaaactccaggtgaagctcaaaataaggcagatcaagccgaagccaacgcaaaagcctatacagatagttttgctgcacgaagagataatcctaaccaagtaacaaaagcacaagttggacttgggaatgtcgaaaatgtgaaacaagcctcacaagcagattttgatgctcatttaagcaatactaaagttcatgtatctgaaggggaaagaaacaaatggaatgctgcccaactaattaaacttactggagacgatggtaaaagaatacaactccaagacggtacagatattcttacattatcttctgggttttattgtgcagttggtcagtcagttgtaaacaacccggtggaaggcgatgcaacttggtataactacgatattgtagaaggcggttcaggaaggaaaacaatagtagcttaccaaagttggggaagcatgatgtggattggaatggttcacactgatggaaaatttagaggatggaaacaaattgcaacaacagattttatagatagagttcaatcagaattagatattcataaaaatgataaaactaatccacattcagttactaaacaacaagtgggtctcggaaatgttgagaatgttaagcaggagacacctgatggtgcgcaaaaaaaagctgatactgctttgaaccaatcaaaagattatactaacagcacggcctttattactagaccattaaattcaataaccgatgcaaatgatttaaatcttccgcctggcacttatcgtttagacactaattacatgaatgcaaatccagaattgcaaaatcaatttccgctaaatgataacagaacaggtttattaattatctacccttctgcaaataaatgggctacacgtcaagattggtttagcatctctacgaaaacactttatacaagggtagctgttaatggtactgagtataccgattggtatatattggaaacatcggaaggttcacaaagtaaagcagataaagctttagctgatgctaaaaactatgttgactctaactatacgaataataaattaacagttcttacaggatccaatgcaattcaagacgctagaacaagcggcaatgagtatccagctgggctgacttttatggatataggagcaaataatacaacaggttacccgcttacctatggcatagtaaaaaatgaaaagtatagtaattatcgatttgctcaatatttttatggnnnnnnnnnnnnnnnnnnnnnnnnnnnnnnnnnnnnnnnnnnnnnnnnncgccattggtggtccgattccggttggacagcttggcataaaatttctggatttgctcatgcaaatatcggaactacaggaaagcagcaattgattaaaggagaacttcaaaaagtaaaatataatagaaaaataaaagatagccataatacttttgatactaaaaacaatagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggcagaaattacccgagaacttaggaggtgcaaaaatgatattatacgacgcaatcatgtacaaataccctgacgctgtgccaagaaaggattttgagctgcgcaatgacggcaatggttcttacattgaaaaatggaacctgcgctcgcccatcccaacacaaaaagaactcgaaacctggtgggaggagctgcaaaaaaacccgccgtacgagccgcccgatcaggtagagcttctcgctcaggagttgtcgcaggaaaagttggcacgtaagcagcttgaagagctgaacaaaactttgggaagcgagctggcagatataaagctttcactactttctttgaaaggagattatgctgaatgaattattgggtgcttgccctctattatgagtgggcgacagcagatatggtaaagcaagcattagcatataaagactgttcaattgaggatctggcagagggtgtgaacaaaaagctgatcacagctgaccagtataaagaaattaccggtaaagccatgtagtaaggcttttttattttgcctgtttttagatcaaaggaggatgaagatggtgaagtatcaatatgaatttcctctcgataggactggaaaagctggcgctgtaaagccctatcgaggaggaaaaaatgattttgtgacacctgtttcgaatttgtcaggcgtagcggagattttaacaaatgcttccttaaaggcgactgaggcatatagtcaactcgggcaggacaggcttggcgcagttctgatttcgaaagtgaagggctgggcgtatgcagatcgtgaaggtacgctctttatagaagaaagcgacaacaacaatgtttggacaacgacagcagcagttaatgtcgcagcaggtgtcctgacagcgacggactgggtatatctttctaaacgctattaccgcttccgctatgtgaacgggaatcttcagcaatccgagtttgtattataccaatcggtcggtgcgggtgagatggatgtgcgtgtcaatggaaaaacgcctttacagattgactttgcggataatcaaacacacgatggacggctgaaagtcgaggctcgcaaaacatttgactttgtctttcatgaaaatgcagagtccgccggcgagggggctgccttacctgttgacggtgccgcgcatttactcgttgaagtctacggcacagcagaaatgagcgaagtcaaattttggggcaaatcggtgtcaggacagaaactgccgatcagaggcgtgaaaactgatgatgctaccactgcctccagtacattaggaaaagccgaggcatgggcctttgatattaaagggtttaaggagattatcatggagattatcagtatcaccggcggtactctttcggtaaaagggaccgcggtttcataacagtctcggccctcggaagggaggtgatctgcatgtgaaggaggagtgagagatgcagcaagaggcagatgtgaatgtgtttcagcaagatttattagacatgaaaggcgagcacaaagcacttgagcagagggtttctgcattagaacgcgtgtctgaccggcaagaccagcaaatcatgacgctgaacgaaaaattaaacaaaattgaagaaaacaccacgtggattaaacgcaccatcacaggtgccatcattacagcagtgtctacaggcatcattggcggagccatcgccattatgtacagcctgctgcagcattaaagggggattttcatgaacacgtttgacaagggcacggtcatcaggacggtgcttcttttaattgctttaatcaaccagaccatgctgatgctcggcaaatcaccattggacattcaggaggagcaggtcaatcagctcgctgacgccctttattcagccggttccattgcatttacaattggaacgacacttgccgcttggtttaaaaacaactatataacagaaaaagggaaaaaacagcgcgacttgttaagggacaataatctgacgaaataaggagagatgaaaatggttaacattattcaagactttattccggttggcgcaaataaccgtccaggctacgcaatgacgccgctctacattacggtgcacaatacagcgaataccgcagtaggggcagatgctgcagcgcatgcccgctatttgaaaaatcctgatacgacgacaagctggcattttacagttgatgatacagaaatttatcagcatctgcctttgaatgaaaacggctggcatgcgggagacggaaatggcagcggcaaccgggcttctatcggaattgaaatttgcgaaaatgctgatggagattttgcaaaagcaacagcaaatgcccagtggctcatcaaaacattaatggctgaacaaaatatcagtctcgccaatgtcgtccctcataagtattggtcagggaaggaatgtccgcgaaaattgttagatacgtgggattcgttcaaagcaggaattgggggaggcggcagccaaacttacgtcgtgaaacagggcgacacgcttacatccatagcgagagcatttggtgttacggttgctcagctgcaagagtggaacaatatcgaagacccgaatcttattcgcgttggtcaagtattaattgtaagtgctccatcgtccactgaagaacccgagctctatccgctccctgatggtatcattcaattgacaacaccttatacctcaggagaacacgtctttcaggtgcaacgagcacttgcggctctgtatttttaccctgataaaggcgctgtcaacaacggaattgacggcatttacggcccgaaaacagctgacgcagtcgcgcgttttcagtctgttaacggcctgactgccgacggtatttacggacctgcgacgaaagcgaagatcgcagcgcaattaagctgatcacagaccacaaaaatcccggagctggttccgggatttattttttcttcttcaactttttaataattccagcactgcgctccctcacccgaagcgagtacccggaaagcccaaaccttccgtaatcaacaaacttcacacgcctcaccaattttttcactgtatcacctgacattatcctctgtttgtatttattatatgtcaccctttaagaaaaggaataaggacaagagctgttttcccttgtccttttagtgtgatcatgctttttttcgtttatactcgtcaatcagccgttcgttttctttgaagattcttgctgtatgcggactgacttgatagcttgcgacactggtggttgaacgttttttcaggattttaaacggcttcgccgctctgggctcgcatctgttttgaaacgcacgttccattatccttcaccttcctcctcaattggcagcaccaaatcatatatgctcgttaatgacgtaaatagcaaataatcaaattcagtgacaatgctgtcagacgtcagcttgatgacatagttctgtgtctcgatggtaaaagggatgagaaccacttttccgtattggtcgtaataaacatcctttcgatcgagccgtgtttgtacatctgccggatcatccatatgctcggttaaccggtctttatcagcctgtgtcgaatagtggcaaagagaagccgttaagttcattttatcagcataggttttcagcagcttatcaataccttcagcataagcatctatacttccataataaacatggatcggttcgtttttcaataggtattggtatgttttcagccgattgagatacatgtggagcatttcgttgttttcttcaagaatttctcttgtgtctgtttcaagctcgctgccggccagttttttgacgtatgcacttaagaagataaaagcatcaatcaaagcaaaactgactgcgacaatgagataccgttcccagtgggtaaatagggaagtgggctcatatgtccagtataccatagcgcctagaacaaacagcaaataccaagttttccggatggcggacattttttctttgaccttcgcttcgaaacgccacgtggcatatacgtataaccccagtccggccacgatgcaccagaccatgatctgaaagaataaaaccatattcgaatccctcacatttgaaataggttctgcttattgtattcgagagatccggatggttttcctgttccatcaaaaaaaccgctcctttgacagaagcggtgtgacattaaaatatcatatttaaaataaagtaggcgatggcaccaagtgtcgctgaaatcggaagcgtgatgacccatgtaatgagcattcgcttggccgtaccccagtttacgccttttacgcggtgggacgcaccgacgccaagaattgatgaagaaatgacgtgggttgtactgaccggcaaatgaataaacgtggcgccgaaaataatggctgctccggttaagtcagcggaaacaccgtttaccggacggattttcatgatctttccgccaacggttttgatgattttccagccgccgattgatgttccgagacccatggctgtcgcgcaggcgaattgcacccaggtaggaatatcattagcagaagtatgtaaattcgctgtgatgagagccattgtgataattcccattgctttttgcgcatcgtttgttccgtgtgtatacgattgcagggcagctgttacaatctgcactctgcggaattgcttattcgttttcgccaagttgctgtctttgaaaatcagcttaacgatgctataaagaataaaaccaaggacaaaggcaataattggtgataggatcagtgcttcaatgattttaatgaagcccttatagtttaacgctgcaaatccggctgccgcaatggctgcaccggcaatagcgccgatgatggcatgggatgagctgcttgggataccgtagtaccatgtgataaggttccaggcaattgcagcgagtagcgcagccaaaatgacaacagagccattttccagcgtataaggatctacgatgtctttcgtaatggttttggcaacacctgtaaacgtcattgctccgacaaagttcatcacagccgccaatataatggcatggcgcggttttaacgcttttgttgataccgaagtcgcaattgcgtttgccgtatcatgaaacccgttgatgaaatcaaacgccagagcacaaatgactattagtatcgttaatattaatagaatatccatttttacccctcgttacgcgtttttcataatgatggtttcaagattattggcaacactttgacaagagtcggcgatttcttcaagcgtttcgtatatttcacgatattgaatgactttgattggatctgtttcatttccgaaaagattctttaatgattttctgtgcaagttgtcacaactgtgctcatactctttaattttgattgcgtgaggctgaatatcctttaagcgattttctgccagcagctcgatcgtaatcaaaatctctttcgcacattctctgatgtatccgctgaatttatcgatatgctcgtctgatgaagtaattgagaaaatctccatcatggcagagaaatgttcgattccgtcaagcacatcatccaagctgtttgtcagctgaaggatatcttcgcgctcaataggagtgatgaacgctttgttaagctctttaatcatgacatgaacatgattgtcaccttttgtttcatattcctttaacgtatctgcaaattctttaagagtcgtttggttagtgaccttaaaattcacaaaatattctgcagtttcgtctatgttctttgcaatttctgttaaaaggagtgagaacttatctttttttcttcttatcattaaaaaccctccatagtttgaatgaacaatgcacacatcaaattattatatagccttttgtcgaaaaaaaacaggtaaagtcgaaaaaaacgtatcttgacttttttgataaatcgtgtctccttattttgacctacttcgctttaaaaaaacgacccaagtttgcaaaaactttctgcttaacgtaaaaagtatatcaaaagttgtgtttttcctgtcaacttttatcttctgtttcaccaaaaaacggttccctaaacaagggaaccgttttatcagcttgcttttcgttttttcatcccgtaatagacaggcagtccggcaaggccgatgaggatggataatccgcagctcattgtatctgtaatgagtgtgctgcctagcacaaagaaggagcccgcgattgccagaattggcataaatggataaagcggaacactgtaggcgcgcttttttccctttgctcgcttgcggagaataaacactgcaaaaaaggccatcacataaaagatgtagatcatgaaaatggagatttctgagagcttatcagggttgctgatcagcatcataatcaaagctaaagcaatttgaaaagaaattgcaatccatggtgtgcggaacgacgggtgtacatgtgacagtttttcagcaaatggaagctgtttgcgttccgccattgcaaatgaaacacgcgggaaagaaagcacctttccatttaagcacccaaagatgctgacgataatccctacactgatcagctttccgccaattgacccgaacagcatggttgccgcggtgcttgtcgcattttcaccaagcgtgacaatttcgttcgctgacaggatgtgaagcaatgcaaaattaatgaaaatatagatcgccgttacaattaataatccgcccgtcatagcgcgtggcagcagcttttcgggatttttcatttctccgccgagagcggcaaggagaatccatccgtcataagcaaacaacgtagctaaaatagccgccccgaagttcatatcagaaatgctttcgtttactgctgtgaagatgtgctgatcgcctttccaaaggccaaagatgatgatgcaggcaatcggaatcagttttccgatcgttgtcagcgtttggacaaaaccgccgtattttgtaccgataatattaatgacgcataaaaagagaactgctataattccaatgacttttgatagtccagatccccagccgaaaagattcgccattaaagatccaaaatataaacccagcgcgccaataatcgccgggccgtaaatgataatctgcacccagccgcacaaaaatccccaaaactcgccgtacacttcttcaaggtacgtataaagcccgccggtttttggaatctgcgttccgatttccgcgattgtcaaaccgcccgccagtgttaaaataccgcctaacagccaggcgaaaagcgccatttttgaatcgcctgaataagcaagcacagcgccgggcttcataaaaacaccagaaccgataatggttccgatgacaagagtaagggcaaacaagaggcctatctcttttttcaaaccgttgtcttcagaatgcatgtccttaacctcctatgatgttgaagcttcatgttgaagaatctattttttcatattgtaaaccctattttagaaaagtgaaataaaataaattttctgattttcgaaatttgctttgggtacagcagataaaactgtggaaacacctgttttaacgatctataaacgaataaaattcatgatttttatttacaaagttcgtgttttctgtattaggattttagccggtacagaggggaggtgagaattcagaaagtgaacgaaccttcggtgaagctgatatgttgactttctcatgcgaataaaatactttgttattagaacaataaatatacaactatgatatgatatcttgaaatcgagataaaataacctggagggacagcatatgaaagttaacggcattcaccacgtatcggcattaacggccgacgcacaaaaaaacttggatttctataagaaagtattaggattaaagctcgtcaaaaaatccgtcaatcaggatgaaccgaccatgtaccatctgttctacggagatgaagtggcaaacccgggaactgagctgacgtttttcgagattccccgcattgcaccgtttcatgcaggaacaaacagtatttcttctattggtttgcgcgtcccaagcacagaagccctgcattactggaaagaacgttttgaagagcagcaagtaacgcacagcggcatctccaaaagagccggacgtgacataatggcatttcaagatcatgaagggcagcgacttgtgctgactgctgatgaggaaggaaaaggatatggcctgcctgttaaacagagcggcattccggaagaattttcgtttcgcgggttagggccggttgaactgactgtgccatatgctgaaccaactttacacgtattgacgaatattcttggatttacagaaatcagccgtgaaccagtcgaagggcaaggaaccgccgttattctggaatcaggagaaggcggtgctgcaacggaaatccatttaatagaaagaaacgatcttccgcgcgagcgtcaaggcaaagggagtgttcaccacgtcgcatttcgggtaagagatgaagaagaacttgccgggtggcaccggatcatcagccgcgaaggctttagcaattccggcattgtggagcgctactatttcaaggcgctgtatttcagagaaccgaacggcattttgttcgagttatcaacggacggaccgggctttatggtagatgaaaatcttgatgagcttggccaaacgatcgctcttccgccgtatcttgagcatcgaagagcagaaattgaagcgaaattgaaaccgatccaataaattgtgattcatttgccttccggcgcgccggagggcttttttattnnnnnnnnnnnnnnnnnnnnnnnnnnnnnnnnnnnnnnnnnnnnnnnnnnnnnnnnnngatttggagaaagggctagaaaccagctgtatataggatgattggcatgaaatggcctcggcaaaaatattgtctttgtttattaatagtttattcatatttgcttgttacactatttccaagttagccaaaaggagtgaaaaacacgtggaaaagaaaaaacgcgagctggatattttcctcatcctcattttgctcgcatctgcattcttaaatatctataacatctggaatgatgatacggtgaatccttattacaccgctgcagtcacaagtatgatgcaaagctttcataattttttctatgcctcattcgacgcggcggggtttataacggttgataaaccgcctattacgtttcagatacaaaccatcagcgcacttatattcggtatgcacggctggagcgtcatcctgcctcaggcacttgctggtgtaggttctgtccttttaatgtatctgttaataaaaccgacattcggtaagacagcagcaagaattgcctctttcatcatggcatgtacaccgattgctgtagctgtagcacgtacaaacaatgttgatgcattactggtatttttcttattgcttgctacatggcttctctttaaagcgatcagaaaaggaaagctgatctggctgttagcagcatttttcgttgttggagtaggatttaatacaaaaatgctgcaggcttacatgattttaccggctttcttattgttctatctgattgcggcaaacgccacaatcaagaaaaaaatcgtttcattggtaagtgcgttagccgtattagcagccgtttcgttatcgtggccgctcattgtcgacaatatccctgcaagcaagcggccttatatcggaagcagccaaaccaactctgttttggaattggctttcggctataacggaatccagcggctgacaggccaaaattcaggcggcggccagggtgcgccaaacaaagacgcttcaaaagaaatgtcttcttctgataacactcaagcaccgcctaatcagtcatcaagcaacagctcatcaagcgatggtaaatcctcaaatggcaatatggcggcgcctccatccaatggccaaatgccaagcggcggtcaaggaggccctccaagcggcggagatggcggccaaggcggacccggcggagacggagggaaaggcggtacaggaaccggttcgaaaatgcaatcaggttcagggatgtttggaacgggaacacctggtccactgcggcttttccaacaagagttatctgatcaaatcagctggcttctgccatttgcgatttttggaatcgcaggcttactgatcgctggcgcgagagaaagaagaagattatctatagagcagaaggaaacggtgttctgggttgcgtggcttgtaccgattgccggattcttcagtgtcgcagaatttttccatcattattatctcatcatgctggcaccgccgattgcggctcttgtcggtgcgggatgggttgctcttgttcatctgtaccgcaatcagacaggctggaaagcatggcttttgccgggagcaattattgcgacaactggatttgaattgtttattctcagaaactacaacgatcaaatcggtgcaggctggagcatcggtgtaggtgttatcggcgcgttgtcagcgattgctttgctgctgtttaaacagcgccaaaaaccgttcagttattatgtttcacttgcagctctcctcgcattgctggtgatgccgatttattgggcaagtacgccacttctgtacggaggcaacagctcactgcctgaaacaggccctcagctcgcatcaatgagcggaaaaggcatgggaatgtctgatgcgactgtaaatgaaaaactgatcaaatatctagaggagaataactccggagctgaatacctatttgccacaaccgattcgaacacagcggcaccatatatcattaaaacgaaaaaagcagtcatggctattggtggatacagcggttctgacccggcaatcacactgactcaattcaaaaaacttgtaaaagaaggaaaagtgaaatacttcttggcttctggaatgggaagaggcggaaacaatgacattgttgaatgggttgagaaaaatggaaaagaagtagcatcagaaaaatggcaatcaagttctgatcaaaaaacagaaaatactgattcggctgatacatcaagcagcaaggcttcaggtgaaaacggcaaaatgggcggacctggcggaatgaatcagtcagcaacattatacgaactacatgctgatgaataggaggcaaaaacatgagcagacatattcaatattcaattgttgtacctgtgtataatgaagagcttgtcattcatgaaacctatcagcgcttaaaagaggtcatggatcaaacgaaggaaaactacgagctgctttttgtcaacgatggcagcaaagaccgcagtattgagattttaagagagcacagcctgatcgatccgagagtgaaaattattgatttttcaaggaattttggacaccagatcgccattacggcgggtatggattatgcacaggggaatgcaatcgtcgtcattgacgccgatttgcaggaccctcctgaactgattttagatatgattgaaaagtggaaggaaggctatgaggtcgtgtacgccgtgcggactaaacgaaaaggggaaacctttttcaaaaaacaaaccgcggctatgttttaccggcttctcagcggtatgacagatattgatatcccgattgatacgggggattttcgtctcatggacagaaaagtctgtgatgaaatgaagagattaaaagaaaaaaatccatttgtcagagggctagtcagctgggtgggctttaaacagacagcggtcgagtatgtacgtgatgaaaggcttgccggagaaacaaagtacccgctcaagaaaatgctgaagctgtcaatggacggtatcacgacattttcacataaaccgctgaagctggcaagctatgcggggattttaatgtcaggtgctggatttctgtatatgtttatcgtgctgtatctgaagctattcacagacagcacgattaccggctggtcatcacttattgtgatccagctcctgttcagcggcattgtccttctgattttgggcgtgatcggcgaatatatcggcagaatctacgatgaagccaaagacaggccgctttacatcgtccaaaaatcgtatggaattgaaaataaaagactctatagagaccagcatatgtcataaccttaaaccccctgtccgtaatggacagggggtttttatgctctgagcccgatctaaagcaaaagatgctgatagatatatggaaattgggtaaagaagagattgtgagcttgtactgcggttcagtcatgccgaaataaaaacagcaaaacttaaagatttcgtcatcggctttgctgcatgtcagctgttatattggggggcttttaagaaacgcatgattagagccgtaccagttatgtttaatagaatactggtacccaatacaattccccacgtcaacgtcgattcagagagaagaaagctcagtaaaagaaaagccaatcctgcgcagatcatactcagtcccacggttttcatgttcatgcctcctagcaaacgatgtttctagcatctgatgtgaatgatgtcaatctgtatgatatacggatatctcgtcagaaagtttcatagagcaattaggtcttttatctaataaaaagcctcagaccgcttttacggcctgaggcattatgtcttacgaagttttctcttctttttgatccagtttaatttttttcgtcatttctttgccgtttcggagaattttcacttcaacggtatcaccgatctttgcgtctttatataagatattgcgcaattcactgcctgtatcaatttctttaccttttaggccgatgataatatcctccgcttttaatccggccttttcagcaggagagcctgaagcgacctcacggatgtaaacacctttattcagctggctgccgaacaggccgagtgtgccttcttggtaattttgcggcacttgttccagatcaagcatgctgacaccgatatatggacgttcaatttgtcctttagacagcagttcttcagcaatcggttttacgtcattgcttggaatggcaaatccgataccctcaacatcatcctcactgattttcatactgttaatgccgacaattttgccgtctgtatttaacaaaggaccgccgctgttacctggattaattgctgcgtctgtctgaatgacgttaatgctcgtttcgccggctgatgtagacattgaaaccgttctgtccacgccgcttacaattccttgtgttactgtgcgggacaggtcttttccaagcggatccccaatcgcaataacggtctcgcctgttctaagatcagatgaatcaccgaagtgtgccacttttgtgacgtggtcatcactgatttggaggacggctaaatcagttaacgagtcactgcctaccagctttgcagtaacctcagtgccgtcatataaagataccttcagtgatgatgccccttctacgacgtggttatttgtaatgatataagccttgccattctcttttttgaaaatgacacctgaccctgaaccgctttctgtatcttcgctggaatcagaagaactagagccgaacaaagagctgtttgattgtgcctgaagatttgtaataccgacaatcgctggtgaaaggtcttctaccatatctgagattttagaagagtcctcgctcttgaatgcagatgagctgcttgagcttgatgagctttttttagattcagaggaggtgcttgttgctgtaacagattgcgtttgctgctggctggatgattgttttgcagtgtcctgagaatcatggtcgccaagcggtgtaaacgtgtaaatgccaagggcaagactgccgccgatcactccgccaagcaacggtctgaaccatccgaagcctcgttttttcttctcctgatcatgaatgacattgcgggccgagtaggaggtgctctgatcgttctctttcgttaaaaagacctcattctcattacctttcgttctgttttcatcacgatagttatccatcatgttcactccgtttctctattttcacatgtctatttatattgataggtttatgacttgagtttatcataaacaaaaactgtgggataaaaatgaaaagattatgggaaattgtgaaaaagtgcggaaaacggtacacttcatattgtatatgaaaggactgagtcgatggaacagattggattgattggatatggcagcatggcggatatgatcgccagacagctgttgaaacatggacaaataaaagagaatgagctatttattgagacgagaacgaagggggagcggctgcgggcactcatgtcagattatccaaacgtatcggctgatccgttggagaattgggcaaatacgtgccaattgattttgatatgcgtcccgccgctccatgtcatcgaaacaatgcgccgtctgcacccgtatgtgaacagaaatactcacatcgtatccatagctgccggtgtgccgctgcgtcttttggaggcagaaacagaagctggtatctcacgtgttattcctgccattacgtccgaagcagaagctggcatctcacttgtcgttcacagtgaagcactggctgcagagaaaaaagaatatctgaatgaattgttatcggttttcagccgtgtacgagaaatcaaagaatcgaatttagatgcggccagcaatttaacgagctcggcaccgggattcatagccgcaatctttgaagaactggcactgtctgccgtcagaaacagcagcctgtccaaagaagaagcctttgattttctgattcattcgctatacggaactggcaagatgctgatcgaaaaaaatatgtctttcgaggagacgctggaacgtgtcgcaaccaaaggcggaataacgggagagggagctgaggtgatacgcgcctctgtgccagacgtttttgatgaggtgtttgaaagaaccctgaaaaaatatgaactgcttacagaacaggttggtaaacagacatgaatccttgaaagaggattctttttttatcactgagtggttgagattttccccagttatattgcatttttcctctttttttaatataatctgttagaatattcataatttagtaaaaaaggaggagcgttatgaaattgtacatgtcagtagatatggaaggtatttcgggtcttccggacgatacctttgtggattccggcaagcggaattatgaacgcggacggcttatcatgactgaagaagcaaactactgtattgctgaagcgtttaacagcgggtgtaccgaggtgctggtcaatgacagtcattcgaagatgaataatctgatggttgaaaagcttcaccctgaagcagacttgatttctggtgacgtcaaaccattttcaatggtggagggactggatgatacgtttacaggcgctttgtttctcggttatcatgcgagagcctcgactcccggtgtcatgtcacacagcatgattttcggcgtccgtcatttttacataaacgatcggcctgtcggtgagcttggattaaatgcatacgttgccggttattatgatgtcccggtattaatggtagccggggatgaccgggcggcgaaggaagcggaagagcttatcccgaacgtggcgacagccgcagtcaaacaaaccatttcaagatccgcagtgaagtgcttgtcccctgcgaaagccggacggctgttgacagaaaaaaccgcgtttgccctgcaaaacaaggacaaagtcaagccgctcacaccgcctgacaggccggttctgagcattgaattcgccaattatggccaagcagaatgggcgaatctgatgccaggaacggaaatcaagacgggaactacaaccgttcaatttcaggcgaaggacatgcttgaagcctatcaggcgatgcttgtcatgactgagcttgcgatgcggacatcattctgctaaaggggtgttttaggctttggcgcgatacatgataaagcgtttttgggcaatggcagctacgattttggtgattaccaccctgacttttgttctcatgaaggtcattcccggatctccttttaacgaggagagaggcacaaatgaagccgttcaaaaaaatctcgaagcctactatcacttagacgatcctctcattttccaatacattttctacttaaaatccatcattacattcgatttcggaccttcaattaaaaaaccgtcggacagcgtaaatgatatgctggaacgcggatttcccgtttcctttgagcttgggatgacagcgattgtcattgctgtgatttctgggctggtgctgggcgtaatcgctgcactccgccgcaatggctttttggactacgccgcgatgagtcttgcagtactcggcatctccatcccgaattttattctggcaacattgctcattcagcaatttgctgtcaatctcaaactatttcccgctgcgacatggacgagcccgattcatatggtgcttccgaccgcagcgcttgctgtagggccaatggcgatcattgccaggctgacacgctcgagcatggttgaagttctgacacaggattatatccgcacagcaaaagcaaaagggctttctccgttcaaaattatcgtaaaacacgcactcagaaatgcactcatgcccgtcattaccgtcctgggcacactcgtcgccagcatcttaacaggaagctttgtcattgaaaaaatctttgccattccgggaatgggaaaatattttgttgaaagcattaatcagcgggactatcccgtgattatgggaacgaccgttttttacagcgtcattctgattatcatgctgtttttggtcgatttggcctacggtctcttagatccgcgcattaaactgcataagaaagggtgaagcgtgtgaatctccctgtacaaacggatgaacgccagccagaacagcacaatcaggtgcctgatgagtggtttgtctcgaatcaggaaaaaaatcgggaagccgattcggtcaagcggccgagtttatcatacacgcaggatgcctggaggaggctgaaaaaaaataaattagcgatggccggactctttattcttttatttctttttgtcatggcagttatcgggccctttttatcgccccatagtgtcgtacgtcaatcgctgacagaacaaaatcttccgccctcagccgatcattggttcggcaccgatgaactcggccgggatgtgtttacccgaacatggtatggcgcgagaatctcgttgtttgtcggcgtgatggcagcactgattgattttttgatcggtgtcatttacggaggcgttgccggctataaaggcggcaggattgacagcattatgatgcggattatcgaagtgctgtacggactgccgtatctgcttgttgtcattttgctgatggtgctcatgggaccgggactgggcacgattattgtggcgcttactgtgaccgggtgggtcggcatggcgagaattgtaagaggccaggtgcttcagattaaaaattatgaatatgtactcgcctcgaaaacctttggcgcgaaaacctttcgcatcatccggaagaatttgctgccgaatactatgggagcgatcatcgtacaaatgacattaaccgtacctgccgccatattcgcagaatcatttttaagctttctcggcctcggcatacaggctccgtttgcaagttggggcgtgatggcgaatgacggcctgcctacgattttatctgggcattggtggcgcctgttttttccggcctttttcatatctctgacgatgtacgcgtttaatgtgctgggggacggattgcaggatgcgcttgaccctaagctgaggaggtagctgtatggaaaaagttctgtcagtccaaaatctgcacgtgtcttttacgacttacggcgggacggttcaggcggtcagaggggtgagctttgatttgtataaaggagaaacctttgcgatcgtcggcgaatccggctgcggcaaaagcgttacctcccaaagcatcatgggcctgcttccgccttattcggcgaaggtgacagacggcagcattctatttaaaaacaaagacctttgccgtctctctgacaaagaaatgagaggtataaggggagccgacatttctatgatttttcaagacccgatgacggcgttaaaccctacgctgactgtcggcgaccagctgggggaagcgctattgcgccacaaaaaaatgagcaaaaaagcggcacggaaagaggtgctttccatgctgtcattggttggtattccagatcccgaagagcgcctaaagcaatatccccaccaattcagcggcggcatgagacagcggattgtcattgcgatggcgctgatttgcgagcctgacatcttaattgcggatgaaccgaccaccgccctggatgtaaccattcaggcacagattttagagctgtttaaagagattcagagaaaaacgaatgtgtctgtcattctgattacacatgatttaggggtcgttgcccaggtagctgacagagtcgcagtcatgtatgccgggaaaatggcggaaatcggcacgagaaaagatattttttatcagccgcagcacccttatacaaaaggcctgctgggttctgtcccgcggctggatttagatggcgctgagctgatcccaatcgacggaacgccgccggatttattttcgcctccgccgggctgcccgtttgccgcccgctgtccgaacaggatggttgtgtgtgacagggtgtacccgggccagacgatcagatctgactcgcacaccgtcaactgctggctgcaggatcaacgagcagagcatgcggtgctgtcaggagatgcgaaggattgaacatgaaaagggggaagaggatgaaacgagtgaaaaagctattgggcatgggtcttgcattaggactttcgtttgcgctgatggggtgcacagcaaatgaacaggccggaaaagaaggcagtcatgataaggcaaaaaccagcggagaaaaggtgctgtatgtaaataatgaaaatgaaccgacttcattcgatccgccgatcggctttaataatgtgtcatggcagccgttaaataacatcatggaggggctgacgcgtcttggcaaagatcatgagcctgagccggcaatggcggagaagtggtctgtttcgaaagataataaaacttacacatttacgattcgggaaaatgcgaaatggacaaacggagatcctgtaacagccggagacttcgaatacgcgtggaagcggatgcttgatccgaaaaaaggcgcttcatcagcattcctaggttattttattgaaggcggcgaagcatataacagcgggaaagggaaaaaagacgatgtgaaggtgacggcaaaggatgatcgaacccttgaagttacactggaagcaccgcaaaaatattttctgagcgttgtgtccaatcctgcgtattttccggtaaatgaaaaggtcgataaagacaatccaaagtggtttgctgaggcggatacatttgtcggaaacggcccgtttaagctgacggaatggaagcatgatgacagcatcactatggagaaaagcgacacgtattgggataaggataccgtgaagcttgataaggtgaaatgggcgatggtcagtgacagaaatacagattatcagatgtttcaatcaggggaacttgataccgcttatgtccctgcagagttaagcgaccagctgatggatcaggataacgtcaagattgttgaccaggcgggtctctatttctatcgatttaatgtcaacatggagccgtttcaaaatgaaaacatcagaaaagcatttgcgatggctgtggatcaagaggaaattgtaaagtacgtcacgaaaaataatgaaaaaccggcgcgcgcctttgtatcgcctggatttacgcagcctgacggcaaagatttccgtgaagcaggcggagacctgatcaagcctaacgaaagcaaagcgaagcagctgctcgaaaagggcatgaaggaagaaaactataataagcttcctgcgatcacgcttacttacagcacaaagccggagcataaaaagattgccgaagctattcagcaaaaattgaaaaatagccttggagtcgatgtgaagctggccaatatggaatggaacgtatttttagaggatcaaaaagcgctgaaattccaattctctcaaagctcatttttgcctgattacgcggaccctatcagttttctggaagcctttcaaacgggaaattcgatgaaccgcacaggctgggccaataaagaatacgatcagctgatcaaacaggcgaaaaatgaagccgatgaaaaaacacggttctctcttatgcatcaagctgaagagctgctcatcaatgaagcgccggtcattccggtttatttttataatcaggttcacctgcaaaatgaacaagtaaagggaattgtccgtcaccctgtcggctatatcgacttaaaatgggcagataaaaactgatggcggtgattgaggaaatactgcttctttatgcgaaggagcggtattttttctctttcttgcacgtatacgtagggtgcagagcaaatgaaaggagtgttttcgttgaattacaagccgaaagcgttgaacaagggtgatacagtcggagtgatcgcgcccgcaagtccgccggatccaaaaaagcttgacaccgcgcttttatttttagaagagctcggtcttcaggtgaagttgggcaaggcgctgaaaaaccagcacggctatttagcgggacaggatgatgagcggctggcggatctccatgagatgttcagagacgatgaggtaaaagcagtgttgtgcgcatgcgggggttttgggacaggacgtatcgccgcgggcattgatttcagcttgatccgcaaacaccctaaaatcttttggggatacagcgatattacgtttttacatactgccattcatcaaaacacaggtcttgtcactttccatggcccgatgctcagcacggatattggccttgacgacgttcacccgctgacaaaagcgtcatataagcagctcttccaggagacggaattcacctatacagaagagctttctcagctgaccgagcttgttcctggaaaagcggaaggcgagcttgtcgggggaaatctgtctttgctgacgtctacactgggcacgccatttgaaattgatacgagaggaaagcttctgtttattgaagatattgacgaggagccttatcaaatcgaccggatgctgaatcagctgaaaatggcggggaagctgacggacgcggcgggaattctagtttgtgattttcacaattgtgtcccggtgaagcgagagaagtctctctcgcttgagcaggtgctggaagactatattatatctgcgggcaggcccgctctgagaggatttaaaatcggccactgctcgccaagtattgcggttccgatcggtgcgaaagctgctatgaatacagcagaaaaaacagtcgtaatagaggcaggcgtttcagaaggggcgctgaagacatgaaaatcattcgaatcgaaacaagccgaatcgctgtcccgctgacaaagccgtttaaaaccgcgcttcgcactgtgtatacggctgaatcagtcatagtaaggattacttatgacagcggtgcagtcggatggggagaagcacccccgacgttagtgattacaggagacagcatggatagcattgaaagtgccattcaccatgtgttgaaaccggcattgcttggaaaaagcctgtccggctgtgaggccatactgcacgacatccagcatcttcttacaggaaatatgagcgcgaaggctgctgtagagatggcgctatacgacggctgggcgcagatgtgcgggctgccgctttatcaaatgcttggcggataccgagatacgctggaaacagactataccgtcagtgtcaactcacctgaagagatggcagctgatgccgagaattatctcaaacaaggcttccaaacgctgaaaataaaggtcggaaaagatgatattgcaacagatatcgcccgtatccaggaaatcagaaaacgtgtcggatcagctgtgaaactgcgtttagacgctaatcagggatggaggccgaaggaagcggtaactgccattcggaaaatggaggatgcgggcctaggcattgagcttgtcgagcagcctgtccataaagatgatctcgctgggcttaaaaaggtgacagatgcaacagatacgccgattatggctgatgaaagtgtttttacaccgcgccaggcgttcgaagttctgcaaacccggagcgcagacttgatcaatattaaattgatgaaagcgggcggcatcagcggagcagagaaaattaatgccatggcggaggcctgcggggtggagtgtatggtcggcagcatgatcgaaacgaagttgggcattacggccgcggcgcattttgcggcaagcaagagaaacatcacacgctttgattttgacgcgccgctgatgctgaaaacagatgtattcaaaggcggcataacatatcgcggcagcacgatttcgatgcctggcaaaccgggcctcggaatcaccggggctgcgcttttgaaaggggaaaaagagcaatgatgcacactgtcatatcagcagtggccaacatctggacagcgcctgattcaccgcatccgtctgatcaattcatgcttcaaccgactgtaatgatcagagactggctggagcgcatgacgtatgatgaacggcttggattatgtacagacaatgtaatccaaactcaggttctctttggcgaaaaggtacttgtgacggcggaacagggggaatgggtttctgtgatcgtgcctagccagccatcccgaaaggatccgcgcggatacccaggctggatgaaaaagaaccagctggaaaaaacaaagcccatccatacacaacacgatgtgatgatcagcaaacctgctgcctttttgtacagaagcaatggagaaaaggagatcgaattgagctttttgacagttctcccccttattgcagaagaaaaaggatattttaaggtttcgaccgttttgggagaaaggtttgtgaagcaaagtgatgcagtgcctgtcagccaacagaaagggactgctgaagacatcattcaaacgggtgcgtttttccttggccttccctacctgtggggagggatcagcgggtttgggtttgattgctccggatttatgtacagtatatttaaggcgaatggatacagcatcccccgcgatgcgggagatcaggctaaggcgggggagtatgtcctgcttgatgatatgaaggctggtgacctgctgttttttgcttatgaggaaggaaaaggagcgattcatcacgtcggtctgtatgtaggcggcgggaaaatgcttcattctccaaagacaggaaaatcaatcgaaatccttacattaaaagacacaagctatgaaaaagaactttgtgcggtgcgccgctgtttttcagaataaggagggagacaaatgacgccactgcctttgttagaggtcagccagctaaaaatgcattttgacgcagggaaaaagcggacagtcaaagctgtcgacggggtcacctttcagattcgtgaaggagaaacgttcgggctagtcggggaatcagggtgcgggaaatcaaccttggggagagtgctgatgcgcctttatcagccgacagaaggaagcgtgacataccgcggcacaaatcttcatgcactgagtgaaaaagagcagtttgccttcaaccgcaaactgcagatgatttttcaggacccttatgcttcacttaacccgcgcatgaccgttcgagaaattattttggagccaatggagattcataacctctacaatacccataaagcacggcttctcgtcgtgaacgagctgcttgaggcagttgggcttcatcccgattttggcagccgttatccgcatgaattcagcggcgggcaaaggcagaggatcgggattgcgagagcactgtcgctgaatcctgaatttatcgtggcggacgaaccgatttctgcacttgatgtctctgttcaagcgcaggtggtcaacctgctgaagcggcttcaaaaagagaaagggcttacgtttttattcattgcccatgatctttcgatggtgaagcatatcagtgacaggatcggtgttatgtacttagggcacatgatggaaattacagagagcggcaccttgtatcgtgaaccgctccatccctatacaaaggcgcttttgtcctcgattccgattccagatcctgaattggaggacaagcgtgagcgtattctcttaaaaggagagctgccgagcccggtcaatccgccaagcggctgcgtgtttcgtacccgctgtccggaggcgatgcctgaatgtggagaatctcgtccccagcttcaagaaatcgaacccggccgttttgtcgcttgccatttgtatcgaaatgctgaaacgaaggaaaaagtaagataaataaaaagagtggctcctttttactagagccactccatttgtttatacttgatgtaaaaactttacacaaaccgggtaagggacagaaaccgttgatgggaggagtgtcaatcggccggtttctttgtctctttcaaacaagacaaggttgcctgtttcttcatttgaagcaacgaggaacccttccgttgggtcaaatacaaagtcacgaggccagtttccttctgtcgacactctttctacgaaagccagctctcctgaatattgattcacttcaaatacggcgatactgtcatggccgcggtttgcgacataaacaaaacgtccgtcctgcgtgacatgtattgcgcttccctggctgttatctgtaaaatcatcagggatggcagaaacgacttggatatctctaaattcgccggctgtcgggttgtattcaagcgcaatcacttcattgcttaattctgtcatgacataagcgtatttttctttcggatgaaaagcgatatggcgaggtcctgcaccgggagcgaaggaatggcttccggattcagtcaacacaccgtctttaagcttataggtgtagagcttatctatacctaaatcaaccgctaccacataattgtgttcaggtgtgaaccccgcgtagtgtgtatgcggtttttcttgtctttcgtgcggcccttttcctgtgtgagcggcctctgaaacaggtgattgcaagctgccgtcttcctgaaccggaaaaacgtgtaccttcccgctgtgataattggcagtcagtacgaattgattttgatcatcaacgcttacgtggcatggcgaagggccatcaattaactgatgattcagaaatgtcaattcgccgctgtttttatcgatttgataggcagcaactccgccttggccgtctgctttttcgatggaataaaggatggcgttgtttttattcggcgccacatatgtcgggttgcccagcttagcggccagctttggctcgctgagtgcttttttctcagtatcaagttcaaatgaataaattccttcgcttccgccttttgtatacgtcccgacatatcctatgtattttgtcatgcgatttcccccttaaaaatgatgtcacctctatattaacgtatcttgataaaataagctgttcaaaacatgaaaaaggggaagattcttcattcgcctcgaatcagcggcattgtgcagcacctgaaggagccgcctgatttaataatttctgacagatcaatttcgataatgtgatagcctcttttcgatagctgttgattgacatggcggttgccagggagactgatgatcgtttttttttccgattgaaaggacgttggtgccaagcgtaaattgttcgtcctcgggcacctcaataagatcataacgttttgccagcatatcggctgcatctggctcaatggcctgtggataaattaacgcttcgctttcagatacaatgttaaatacgcagtccaaatgcaaaaatttttcatgaagcttcactggaacgatcgtatattcaggaagtgcctcttccagctggccgatagctgaaatgtcggtgcgctggctgattccgacatagacaatgtcatcatcgataatgacgtctccgccttcaatactcgtatcaagcatgcgggtgtaagagataccttggctgtgaaaaaaatcttttataacggcttcttctccttggcgaatcggttcagtcatgcttgacagaaaggctttttctccgatgacaaatcctatgtccctagtaaaaacctgttctgggagtccgtcgcgaacgggcaaaaggacgacctcaacgttgtgtgacctaagtgcctccactaaacggctgtgctggtcgttggcggtttttacatgaatattgtcatcttcaaaatgtttttgtgtttcgtttataacatcttttatggtcatgtgctcaggtttgcataagatcactttctgaagtgtgccgtattccgttcggcatactgttttgtgctgagatttcgggatggatacgtccatttgtttttcctcctaaagtgtgaagaatacatttattattccctcatcatgaaaatcattaaaccattttaaattttagacaaatggaagagaatattgtttaataggagaatataagtgcatttagctaaaagatcagacatcaaaggggagaaaggtatggaaacaccggaaacaagattttgtaaagagtcaaaggttgtgaaaaccagcagggtgttcccgcttgacacgaacaaccataatacgctgtttggcggaaaattaatgagctacatagacgacattgcctctatttcagcggcgcgccattgcagacgtgaaacggtaacagcttcaatggattctgtagattttttaaagccgatcgggcaaaaggattctgtctgcctagagtcatatgtgacatgggtcggcacatcttccatggaagtatttgtgaaagttattaaggagcatttgatgactggcgaacgggaactcgctgccacatcctttttgacatttgtcgcattagattcaaatggcaagccggtgcctgtaccgagggttgtaccggaaacagaagaagaaatcatgctgcataatacagctgtacagcgcgctaatgaacgtaagaaccgcaagaaacacagccaggcgcttgcaaatgcgctcggaactgataagccttggtgaacgttaaacccaaaacataagttgttttgggtttttttgtacttttcaatggtgattattacaatggttagtccgtttttgctaggggattctataaaaaagcaacaaatgtcatgttaaattgataattttgtgacaactttattaaagattcattttagatatatcttttattcgtaagatcgtgtattttaaagatatattttaaatacatcttttcgaaaggattgtttataaaatgttagataacaaaacaatcgaaattattaaaagcactgtacccgtattgcaacagcatggagaaacaatcactggccgtttttacgatcggatgtttcaagaccatccagagcttttgaacatttttaatcaaacaaaccaaaagaaaaaaacacagcgaactgcactggcaaatgctgttattgcagctgcggcaaacattgaccaattaggaaacatcattccggttgtcaaacaaatcggccacaagcaccgcagtatcggaattaagcctgagcactacccaatcgtcggtaaatatttgctgattgcgattaaagatgtattgggagacgctgcaactcctgacattatgcaggcatgggaaaaagcgtacggagtcattgctgacgcgttcatcggaattgaaaaagacatgtatgaacaggctgaagagcaagccggcggctggaaggagtataagccattcgttatcgcaaaaaaagagcgggaaagcaaagaaattacatccttctatttgaaaccggaagacggcaagccgttacctgaattccaagcagggcaatatatcagcatcaaagtgcggattcctgattctgaatatacgcatatccgccagtacagcctgtctgatatgccgggaaaagactattatcgaatttccgtgaagaaggatggtgtcgtgtcttcctacttacacgatgggctgcaggagggagattcaatagagatcagcgcaccggcaggggactttgttttagatcatgcatcacaaaaagatctcgttttgatcagtgccggagttggcattacaccaatgatcagcatgctgaaaacatctgtttccaaacagcctgaacgacaaattctgttcattcatgcggcgaaaaacagtgaatatcatgcattgcgccatgaagtagaagaagcagcaaaacattctgctgttaaaacagcatttgtgtatcgcgagccgacagaggaagaccgtgcaggtgatctgcattttcatgaaggacagattgatcagcaattcctcaaagaactgattgccaacaccgatgcggattactatatttgcggttcaccgtcgtttattacggcaatgcataagcttgtatcagagctcggatcagcgccggagtctatccattacgagctattcggcccgcaattaagtttggcgcagtccgtttgaacacatacatgaaactcttctcctttcagagaagagttttttattgagatataagaaggcagacaagcgccggtttctacatccggacaatcacagacccgccgccatttgtgcatacacggttttgctgttcttgcattgttctcagcaattcattgtttacctcaatcgctctaattagttgctccatccttagctccaaaccagccagcctgtcgattgtttgctgctggtagctctcgggttgggaagccaaaggcagatcaaagggccaaagggcattcgacttctgatttttcatattgcgtattgcgcctccaatcggtgtcactttctattgtgttatgttcagtcgatatgcacgttcgcctagacactgatgcatagagggcctgccacggggcacaataggctcaatatgaccagcggatggaggtaaagattggtgttatggatggtatgggtatttttactgaagccagttatcgtattttcgattgcatatattttgtttcggcttgccggtaaaaaagctgtgtcacaaatgaacaattttgacctgcttttgacctttgcaatcggaaccattatcagtgagccgatccttacatccaagctgccgatgtcaatttattatgcgggtgcttttttggtgctttatcttatcatgagcaagctctctttatctaataaatggcgatggctcctggtcgtgagcccgactgtcctaatccgaaacggggatattgatgaacgcggccttcgtaaagaaaggctgactgttaatgaactgctcggaaagctgagggaaaagggctatgccgacccggctgacattgatcttgctatcattgaagaaacgggagaagtaagcgtcatcccgaaagaggaagcgagagcggtgcaggtgcgggatttgaatatggaagctgaacggaattttatcccgattccgctcatactggatggcgaaatccttgatcataatttgaaatatctccaaaaaaaccgatcctggctgtttgagaagcttgaggaaaaagggtacagccccaaactgctgtcttcgatcaccttaggcacgatgaatgcgcgaggtgatatatcccttgatttaaatacctctaatgacccgcagcatgatccttacttatataaaccgggaaataacaactaagatggctctctcttgtaatgagagcttttttcttttttaaagggaatttttgtttggtgtcaaatgtacctagttaggaggggaactgaacatgaaggacttatccataagaaacgacatggcgccaacggtcagtctgctgtattccgcagtggaagaaaacagtctccgtctggcttctatcgtaagccatatgacacacagtgaactttactataaggggcgctgccaaacaaaaaacagcacggctcagcttttgcaccatatcacaaatgttgatatcagatgggtctggcgtatcaaggaaaatcggatcccggaccatattgaacaggcatacggcccgatgacagatgaaagcggacggctgcctgaaccggtgaatcagccagacttagatgaactcctgaaaagacatcagcatgtagtagagaagctgaaatcggtatgcttcactttaactgaaaatgctttgaaccagccgctttccttcgaaggtgacaccgcgacgatacgatggggaatttggcatatggcagatcataaccgctatcatcaggcacatattgaagctctcaaaaaagaatggaagcaggatgtggcgaagtatgaacgctaaaacgaagcttgtgactgatcgaattcgtttgcgctgtatggaagatcgggatcaagccactttgtttgggctgctttttaatgatcctgacgtcatgacatattattccggtttaaaagataagaggcaaacccgcgagtgggtcaattggaaccaacgaaatgaaaaagggtacggcgttagtctgtggatcgccgaagataagcggacaggggagtttttggggcaatgcggcatcgttccccagcagatcgaaaatcaaaccgtaatggaaattggctatatgtttgcccgccgccactgggggaacggctatgcgcaagaagcggctcgggcctgtctggactatggctttaacgagcggcagttcggcaaaatggcggctttgattgatccgggtaacaaagcgtccatacgggtagcggagaaaatcggcatgcattacagcaaaacgatcagaaaatggaataaaccgatcgcggtatatgaaagaaaatcttacaattgaaagatagagctgagtttagtatcatgatatcatgtaaagttttctagggttccgcatgtcaattgacatggactggtccgagagaaaacacatacgcgtaaatagaagcgcgtatgcacacggagggaaaaaagcccgggagagtcaatctcatgtgagacgactgtccggggtttttttgttttcggagaatcttaatagatagaaaggaatgactcaaaatgaaatggggattggtcgtgcttgccgctgttttcgaggttgtttgggtgataggcttaaagcacgctgactcagccttaacatggagcggcactgccatcggcatcatattcagcttttaccttctaatgaaggcgactcacagtctgcctgttggtaccgtgtatgccgtctttaccgggctcggcacagcgggaacagtacttagtgaaatcgttctttttcatgaaccggttggatggccgaagctattgttaattggcgtgctcttaatcggtgtaatcgggttgaagcttgtgacacaggatgagacagaggaaaaaggaggcgaggcataatgctgcactggatcagtttattgtgcgcgggctgtttagaaatggccggcgtggcccttatgaatcaatatgcgaaagaaaaaagcgtgaaatgggtgctgttgatcattgttggttttgccgcttcattttccttgctgtcgtacgcaatggaaaccattccgatgggaacggcttacgcggtctggacaggaattggcaccgccggcggggcgcttatcggcatcctcttttacaaggagcagaaagacgccaaacggatcttctttatcgcgttgattttatgctcagcagttggtttaaaaattctgtcataaattgatttttatcaaatcttcagtataatggataaatagtttagacttacaaagataagagggattattcatgaaatcatatatgactcagcggttggacgaataccgtgacggaaatgaggataaaggtcggctcttggtcagctgccccgatcagccgggtatcgtctctgcagtttccgcgtttttatttgaacacggtgccaatattatagaatcaaatcaatatacgacagaccctgaaggcggccggttcttcctgagaatcgaattcgactgcgcaggcattcgtgaaaaaaaatcatcacttcaggcagcgtttgcctctgttgcggaaaaattcgacatgacatggagcttaactttggcgagcgaactgaagcgtgtcgccattttcgtttcaaaggagctccactgcctgcatgagctgatttgggaatggcaaaccggcaacctgatggcggagatcgctgttgtcatcagtaaccatgaggaagcgagagagctggttgagcgcctgaacattccattccactatatgaaagcgaacaaagacatcagagcggaagtcgaaaagaagcagcttgaactgctggagcagtacgatgttgatgtgatcgtgctcgcacgctatatgcagattctaactcctgattttgtttcggctcatccgaatcgcatcatcaatatccaccattcattcctgccagcttttatcggtgcgaatccgtacaaacgggcctacgagcgcggcgtgaaactgatcggtgcgacatctcattatgtgacaaacgatcttgatgaagggccgatcattgaacaggatattgagcgtgtggaccaccgcgataatgcggaagcgctgaaaaacatcggaagaacaattgagcgcagcgtgcttgcccgtgctgtgaaatggcatttggaagaccgtgtcatcgttcatgaaaataaaacaatcgtctttaactagactgcaagaggcccgcgcaatgcgggctatttttgatgacaaaaaaccttgacaagtgtcttttttctttgcataatataaaaaaatcattgagcgttgaagaggattagtaagcagacctttctgtgacagagagcaaaatgaatcgctgaaacattttgccgcatgaaacctgccgaacctgccttggagtcctagggggaaaacctaggcgcataacctggcgttacaggagagcggagcgtgcacaagcgcgttcaatcaaggtggtaccacggaaacccatttcgtccttatgaatcaggatgaaatgggtttttttattgtagaagagccgcggaggagaataaatgaaaaaacaaagaatagtagtgaaaataggaagcagttcgctcacgaatagcaaaggaagcattgatgaggcaaaaatcagagagcatgttcaggcgatttccgtgttaaaaaaagcggggcatgaaatgattctgattacctcgggtgccgtagcggcggggttttccagcctcggttatccatcccgtcccgttaccatcaaaggaaaacaggcggcggccgcggtcggacaaacactgttaatgcagcaatatatgaatcaatttaaacaatactcactgactccgggacaaatccttttaacgagaaatgatttttcgaaaagagaacggtaccgaaacgcgtatgctacgataatggaattattagagcggggcgtcattccgattatcaacgagaacgattctacatctgttgaagaattgacattcggagataatgatatgctttctgcgttagtcagcggattgattcacgcggaccagctcatgattctcactgacattaacggactgtatgatgccaatccaaatgaaaatcctgaggcgaaacgatttgattatttgccagagatcacgcctgaattgcttggatatgcaggttcagctggatcaaaggtcggcaccggcggaatgaaatcaaagctgttagccacacaaaccgcgctgtctctgggagtgaaagtattcattggaactggcagcggagagcaaaaacttgcggacattttggacggcaggggagacggcacttatatcggagacaaagaactatcttcggttaacaacacaaggcagtggattcagttccactcgccgatatcgggagaaattatcattgatgcgggtgccgaagaggcgatgatccataatggaagcagccttttgcccgctggagttgtgggcgtgaacggaagctttccgaaaggggcggttgtggaagtcaggggaccgggcggcgtgatcggcaaaggccaaactcattactcctccgaggagattatggaggctaaaggcaaacgcagtgacgaacttgattttgagaaaacgtttgaggttattcataggaatgactgggtcaatgtaaaagactaggaggcggaaaaatgagtgaagtttctgtaaaagcgaagctggcgaaagaagcagcagccgaaatgatcatgaaaacaacagccgagaaggatgaggcgctcagcctcattgcaaacggactccgcaaagaactggattttctcttggcggagaatgcaaaagacattgtgaacggaaaagagaatggtttaacaccggacatcattgaccgtctctcattggatgagaaacggatacgcgatatcgcggacgcggtggagctcttaatcgacttagcggacccaatcggcgactctcttgaaacgattgaaaaagaaaacggcctgtttattgaaaaaatccgtgtgccgctcggtgtcgtaggaatgatttatgaggcgaggccaaacgtcacagttgatgcagctaccctttgcctgaagacagggaacgcggttgtgctgcggggaagctcctcagccatccacagcaacaaagcgctcgtcagtgtcatttacagagcacttgagcaatcagcgcttccgattcacgctgtgcagctgattgaggatacgagcagagagacagcaaaagagctctttacgttaaatgatggcttagacgtattgattccgcgcggaggcaagaaactgattgatctcgttgtgagagaatcaacagttcctgtattagaaacgggagcaggaaactgccacatattcattgacgaaacagccaaaccgcaaatggcagaaaaggttgttgtaaatgccaaaacgcagcgcccttctgtatgcaacgcgattgaatcattgctgattcacaaggcttgggcaagacagcacggaaaagaattgctggaccagctggaaaacgcgggagttgaaattcgcggtgatgaattggtatgtgaacttcatccttcaagcaaacaagcatcaaaagaagattgggaaaccgaatttttagcgcctgtcctcagcgtaaagacggttgaaaacgtccaagaagctgtaaagcatatccaacaatacggcaccaatcattctgaagcgattttaactgaaaatgacaaaaatgcggtatattttcaaacggctgtcgatgctgccgctgtctatcataacgcgtcaacccgctttaccgacggctttgaattcggctacggagccgaaatcggcatcagcacgcaaaagcttcatgcaagaggaccgatggggcttcctgcactgacttctacaaaatacatcattaaaggaactgggcaaatccgtgaatagcagggcaatgttcaatgaaaaagcttatctcattacgagataagcttttttatacgcgaaaaattgacatttcaaatttaattgtgtacaatttaattatataaaatatattgggggaatgaaaaatgagtcagccattatttacagcaactgtttcagcggtaggaggaagagaaggaaaggtcatttcatcagaccgcgttcttgagcttgatgtcgcaatgccggggacaccgagagccaagaaattagaaaaagcgacaaatccagagcagctgtttgcagcaggttatgcagcttgctttgacagcgccctgcagcttgtcgcaagaacagaacgggtaaaagtagagacagaggttacagcgaatgttagcctgttaaaggatgaagcggaccagggctataagctgggtgtgacgctgcaagtaaaaggagaaggagtcagtgcatcagaattggaggcgcttgtgaaaaaagcgcacggcgtctgcccgtactcaaaagcaacctccggaaatattgatgtgacacttgaagttgctgaataaataaaaagaggatgcctgtacaaggcatcctcaatttttttgatggagtgtttccagcaatgtatatagagcggattttaactgtttgagatcctctccagactgctttgagagccccagaattgtttctggaatgtcaaccgctttttcttttaataacgctccgtcctctgtcaggctgatcaacacggaccgctcatcctcttcagatctttttctcgtaatcaaaccctgttgttccattcgtttaagcatcggagtgagcgtccctgaatctaaatacagctgttcgcccatttttttgacagtaagcgtttcatgttcccataacaaaagcaaagccaaatattgagggtatgttatattcagcttatcaagcagcggcttgtattgctttgtcatttcccgcgaacttgcatatagcaaaaaacatagctgattctccaatttcatatgatcaaatttattttccattttgttcaccaactcttttttgtcattcgattctattgtatctgaaaaacctcacttttcctattctcggcaaacatagcatgtttaaaaagatcagaaagggaaatataacaactagatacaaataaggaggttgggaaatatggcactatttacagcaaaagtaaccgcgcgaggcggacgggcaggacatattacatcagatgacggtgttcttgattttgatattgtcatgccaaatgccaaaaaagaaggacaaaccggcacaaatccggaacagctctttgcggcagggtatgctgcatgcttcggcggcgcgctcgaacacgtagccaaagagcagaatatcgaaattgattcggagattgaagggcaggtcagcctcatgaaggatgagagcgacggcgggtttaaaatcggtgtcacacttgttgtgaacacgaaagatttagatcgggaaaaggcacaagagcttgtcaacgccgctcatgaattctgtccttactcaaaggcaaccagaggaaatgttgatgtaaaactcgaattaaaataatgaccggcatcctgagtgttctcaggatgtttttttggtgtcggagcatgcggggcgggcacagatttttgataaaacgtcagagaagcgtttgaagcatgcctttaaaccaaaagttacaggtgaagcgggtggctggctcggtgtctgccaagctgaattccggcgcgcatgattgctgttttgtatttgcacagggcatagcgctacttggagaaataacaaggaccaggccgcacatgcctgatccttttaatattctttcttattggcgaagttccgccatgcttgaaacggggataaatgctctgttagtgtcacttgataaaaggggatcgtcctttcttcagcaggtttatcaatttctttataaatgaatgaatcatcaaacccggcttcggcagcgtctgtgtgctcagctgcatagaaaacagctttaggccgggcccagtagatggcgcccaagcacattgggcatggttcacagctcgtatacaaaatgcagtcatcaagctggtatgctcctagcaccttacaggctttccgaatagctgtgacttccgcgtgggcagtcggatcattgcttgttgtgacgttgttctgtccctctgcaataatggctccgtctttcacgataacagctccaaaaggcccgccgattcctgcattcactccttcacatgcgagagtgacagcccgttttaagaacgtttcatgattcatcccaatccctcctgtcaatagagtgttattagtatagccgaaaagaatgcaaagaacattcttaaaaaagtgcaaaataaacaaagtatttgggagatttgctaaaataagaaactgattgttgctgtattatagaaaaaaaccatctgccaaatgcagatggttttttcaaattatactagctgtgtctgctgtgctcttgcctgttttgcagcttcaaccatgtttttcaatgctgcaaccgtttcttcctgctgtcttgttttcaatccgcagtctggatttacccagaagcggtcagtcggacagacggcaagcgcatcaacgataatattgtacatttcttcagttgacggcacacgagggctgtgaatgtcatatacaccaaggccaagccctttcaaatacgggtggttttttaagtaatctaaaaatcctccgtggcttctgctatgttcgattgtaatcacatcggcatcaagatcattgattgtatcaacgatatcttcgaagttgctgtaacacatatgtgtatgaatttgtgtctcgtttttcacggaagaagtggttaatctgaatgcttctgccgcccaagtcaaatactcatcccaatcgcgtgttttcaatggaaggccttcgcgcagcgctggttcatcaacttgaatgatttgaatgcctgcgtcttcaagcgctttaacttctttgcgaagggcaagcccgatttggaaggcgatttctttcctcgagatgtcgtttcgagggaaagaccagtttaagattgtaaccgggcccgtcagcattcctttcacatgcttggaagtcaatgactgtgcgtagactgtgtctttcactgtcatcggttcaataaattcaacatctccgtaaatgactggcgggcggacacagcgtgagccgtatgattgaacccaggcatatttagtgaaggcgaaaccagccagcttttcaccgaagtattcgaccatgtctgtccgttcaaattcgccgtgaacaaggacatcaagctccaattcttcctgaatatcaatccatctttttgtttccgcattgataaagttttgatactgttcatcggaccactcagctttccgccatttttggcgtgcgctccgcacttcagcagactgcgggaagctgccgatcgttgtcgtcggcaaaagcggaaggccgagagattcattttgcagggctaaacgttcttcaaacggaatcgggcgcttgaagtctttatcagttaattgctcaagctctttcttttgttcagaattggcgcctgttgcaaactgtttaagcgcctggatatcagccttagcctgctgaatctcttcgctgatcgccgcttttcctgatactaagccttctttcaaagctgttagctcggccagcttttcttttgcgtaggataatccgttcaataggtctttttccaagtgctcatcagggtgtttcgctactggaacatgcagcaggctgctggaaggctgaatccacagttcatcaacttttgcaatgctgagaatatcaagaacggcatcgagacgctcttcaaggtccgctttccaaatgttgcgtccgtcgataacgccggctgccagcactttgtctgtcgggaagccatgtgttttaagctgttccaggtttctgcctttgtcgtgaacgaaatcaaggccaattccctgaaccgggtaagagatcagctcttcataagcatcaacagaatcaaaatacgtctgcaaaagcacattcaaggatgaaagctcacttgtaatgctttcaaataattcttttgcaccgcgtacatcttcactagaggcggtaacgagcgccggctcatcgatttgaacccattttacgccttcttcttcaagctctttcaaaagctgtacatataatggcacaaggcgtttttggatcgcttttgcttcagacggttcatagcctttagcaagcgtaacgaacgtataaggaccgacaatcacaggctttgtttccacaccgtattcctgtttgatccggcgataatcttcgagttgtttgtttctggtcaaacggaactcaatgctctcgtcatattccggaacgatgtaatgataatttgtattaaaccattttgtcatttcactagatacggcgtctttgattccgcgggcgatagcgaagtatgtatcggtagcgtcagtcaaatgtctgaaacgtttcgggatccagttgaagctgactgctgtgtcgagtacatggtcatactgtgtgaaatcagaaacaggcacaacatcaatctgctggtcaatttgtgtttttactgcggataaaaatagttcgtcgatatgcttcaaaaacgtatctttatcagtactgcctttccaatacgcttcaagtgcttttttccattcccggttcagtccgattctcggaaatcctaaattcgatgttttgatggttgtcattgtttctcctcctttatatgtaaaacactctctttaacccgcggatacaggctgctaagaggttttctcacaacaaaaagcctctttcccatgagagaaagaggcttttctacgtaaaacactgcctctctcatctctcagacacaatctgatggaattagcaccgtgccttatgagacatcagtctcggcgcgaaaagcagtgcgccccatttcacaatggtattacggtcggttgctgttggggtcaaaaggccaatccctcgcccaactctcgataagagaaaatgttattaattttttgaaaagttgaatcatttgttggtaatcttaacagtaattcaaattcattgtcaacatagaatttgaaatttttatttacatgatgtggtgtatattatataagaaaaataatcttatagggtcaacaaatgtgattgctctgctttttctgcgagctcatcaggagctgttaaatacaggaatccattgcctgccagcgtttttgcaatatcaagaggaagtgtcctgcggattagctgtgcgaaaacctcagattcagaaagctttctttgaaatgattcttcttcatagcttttgattaaagcaagcgcaccgctgacatgaggggcagccattgaagtgccggtcagcttaccgtacttcttgttgggaagggtggataagatgttttctcctggtgccacaaggtcaatctctttattcgcgttagaaaattctgataattctcgcgctactgaaacagatccaactgcaatgacttcgttataagctgcggggtaggaaagctcttctgtgcgttcgtcgccgtcaccttcatttcccgctgcacaaacgacaagcactccgtttttgactgcgtttttcactgcttcttccagctctggcacatcgcttggccctccaagggacattgagatgatgtcgactttctgttccaccgcgtagttgatgccgttgattatccattcgtattgtccgctgccgttctcgccgccaagaaccttcacaatcaataggcttgcctcaggcgcgactccggcaatgcctccgtttgaatcattagctgcaatcgttccggcgacgtgtgtgccgtgtccgttgtagtcggaaatcgcatcttccttgccgccgtcgtcatccgtgaagttctttccgccgatgatttgattttttaaatcagggtggcttgtgtcgcagcccgtgtctaatacagcaactttaatatttttgccttttaccccttttgcccacatttctggcgccttaatcactttaatgccctcaggaagctcgtttacatccatgatctgctcattcgtcacatacgggatcaagcggatttcaccattcataaaaaagccctccttttttatgcttgcaagtggattcaagggtgttgcctcatattatatgaaaaaaacaagcgctcggacagagccatttgaagcattttgaaaaaataggatacacaccaaagaattagtaattttcaaaatattggatggcttcggcgtgtatgactgggattcaactgtaagtcaagttataatagtgttggggaaaggagcagtgtcatgaaactgaatgaaaaattatatgcatttttttcagagcatgtggaacaaatggccgaggaatggattgaaacgatggaggaaagtgatccgaattcgctttacgccctacataatgcaacagtaacggaagaattgaaagagcaggacagagaattttaccggcatctgaattacatgtatgttttaccggaaaaacaatttctcgaagagtttcaagagtgggtcattgagctgaccaacgatcaaaaacatctcgacacaccggttcagtatgtcattcgggagtttatgagaaacaggagattatatacgaagtattttgagaagttcgcagaagaaaatgaatcagcgtttgaaccgggagagaagcaaaaatgggcagatttgattgtaaaagtatttgatttcaccatttatacattcgttgatcacgctgaaatgaatgccaagcagcaattaaacgcccaaagagaaatgatattggaattaagctcacctgtcattaccctgagcaaatcaacagctttgctgccccttgtcggtgacattgataccgaacgggcgaagtttattctggaaaacacgcttcaagcttgtgcgaaaagacgtgtggagcatctgttaatcgatctgtcaggtgttgttgtggtggatacgatggtggcgcaccagatctttaaattgattgaggcgcttaatctgatcggtgtccggtcaaccctgtcaggaatcaggcctgaaattgcgcaaactgctgtacagctggggattgacttttcgaatattaccattaaaaccaaccttgcccaagcattaaactatcatcaataaaaaaatccgctatctgtgatagcggattttttatgatgcgaaacataaagatacgagaaaggatcccgcgaataataagaggacgaggcaaaagaacacccagtcgcgccggttcacgctcaatttcctataatatgtccggtttctgcttcctgtaaaacctttcgattccatcgcaagcgctgtccgttccgcttttctgatggcgcttgccaatagcggtatggtatatcgttttaacgcactgattttattcatgatgccgctctccgccgctcctcctctgattttatgagcctgctgaatcagctggatctcatcctttaacagcggaagaaagcgaaagcctgcaatgacaccgtacgcgagctttggtgagagcctgcactgctggacaaggctcagcataaataaaatcggatcggttgtaaaaacaaacatcatcgataaggcggaaaagcataaaatacgaaacccgagagagatgccgacagacacattatcgctgttaattgagatagggcctgcttgaaacaaaaaattatccggtgttgtcggcacttttccaaaaactgcggctgtccacacgcatccgaatgctaaaatcaaaaacggaatcgtaaacaacaaccattttttcaatgggattccggccgccagtagaacgcccgcaacgatgatgatataaaaacatgccggagtgtatgggttgtaaataaacgacagcatgacgacacaacaaaaaaccgccgccgctttcacagtcggattaatgagatgtaacggctgcttcatcacgcacctcctcttgaaatgccatccattcatatagaaggggaagggtgagctttgctttttgaacaagccctgtttcttgagaaaacaactgcgctggagatccgtcaaaggccaggcctgtatcgtgaagcacaagcacgctgtcagcatacgaagagactagctccatatcgtgtgtaatcataaggacagcggttccctctgccttgatacgctgaatcatttccatgcattcagccgccgtgcgggcatcctggccaaaggttggttcgtctaataataaaacctttacgtcatgcatgagcatagtagcaacgctcagtcgccgtttttgcccttggctgatcgcaaacggatgatgatcagccaaatgcgcaagaccaaaacgctgcagcaggtgttgcgcttttttctcagtttcagcatttgctttctggccgaacagaagctcgtcatacaccgtatcggtgacgaattgatgctcagggttttgaaaaacaaatcccatccgtttacgcaattctttttctttatatttctgcagcggctggtcataaagaaggattttgccgctttgcggtttcatgagacgggccagaactgataagagcgtcgattttccagtgccgttcggaccgacaagcgccgttaaggagccttcgcgcaacgaaaagctgatgtcattgaaaatcgcctgctgtcctctcgcgaacgaaaggctgctgacttcaagcacactctccccagaaggggctttcttctttttgacatgcccggcaggaataggctctttgaacagcatctcttttgataaagtaaacggcatcctcagctttttctgcagatgacagacctttggaatggggatgcccaatttctttagtgtttccgcttcatgctgaaatagatttttcgtcaggccatccagcgcctttttgcctgatttgtcgagtacgatcgttctctcaatccaaggcgcccattcatcaagctggtgctcaatgacgaggaggctgaaacctttttcccgctgaagatctttcatcagatgaacgaactcccgcgctgagaaagggtctaaaagagaggtcggctcatctaaaataataagctcaggctccatcgccaaaatacaggcgagagccactttctgcttttgtcctcctgaaagggttgagatcattttttcttttaaatgggtaatgcgtaatttttctaatacggcgttgattttctctgtcattgcttcttttggaatttgcagattttccagcccgaacgcaatttcgtcctccaccgtcagcatgcagaactgctgatcaggatcctgaaaaacgaccccggcatgctgagcaatcgtttcggaggtttcagcatctgtgaccggcttttgaaatagaaagacatgtccggactgaatgccgtcgcaagcctccggatatagaccgtttaaacaaagggcgagcgagcttttaccgcatccgctcggtcctaataataaaacacattctcctttttgaagcccaaacgaaatgtcttgaaaaaccggtttctcgtcttcttcataagagaagctgagctgctcaaccgtcagaagctcatcaaaggcttgcatgttctgacgcccgcttccgtttctttttcagttcctttccgagtgccattccgtttaacacacctgtataagcgagagagtcgctgacagcttttccgagaagccccgccaaaagcgcgccggaaatgagacggatcacaagcataatgagcagataacctggtgaataggctgcatagccagaaacaaagagatcatagataaagctggctactgaagaccccataccggccagcataaggacagggagagagtatgctttccagcgtgttgcaagaaatacagcctcagccccgagcccttgaacaatgccaatgacgatgaccatcgggccagacggatttcccagcaggcactcaacgagagcggcaatgatttcagaaacgagcgccgcacccggttttcgaatcatgtacgcggcgattacagaaacgataaaccaaatgccgtaaatcggttcataggcgattggcccaaacatacctgcaagcacgtttccgaaatgtgtaaataataaataaacaacggcaaatacgatactgataacggacatgatgacaatttcttttactttccagcttttcatgttatccctgctttctgttttttcttgatggactgttagccgaaagattcacagtcatggtgatgtggtttgtttgctgctcagccatgcggaaaacggcttccaatgtgctgaatacgtcatgcgcatccccgtcaagctcgctcgtgtaatggacaccctgtacgaaagtgcctcgggcttttgcaatgtcgaccgcctttttaatcaatcccatataatccggctcgttcattggataaagggcaaattggcacggcgcttccgccttcaagcctcggacagcatcttcattgacacgcttatcacctttggaaagatatgtatccccctgtgtgtcacccgggcatccaatggaaaacgtgccgttcatgacgatgtgtttttcgctgtttgctgcatgaaggtaaatggcttttgcagcatcgaatacatgatcaatcgatccgcgtaacaccgtgctgatatggtcggttttcgtccataccttggatgtatctgtttttttcagcgcagacttgatcacactgataaaatcatccgtcatcggatataaagagaagcgaaaaccggcgattctgcttgtaccgcaaatatgctccatttctccgacctcctgtttttttggtaaaataaaaaactgcatatcctaagggaatatgcagtcatagatcgattaagcgcacaaaaaatacaccattcggtcaacctgcacttccccacgctggtattatccagatcgggtcataagggatcaaagcgcgtttctttcgcgctttatctcagccaaaacagcacccctagtgctttccgtatacaattttttattttgacatcataatagatgataagaatcattttgtaaacaacgaaatcatttttttcaaatagggacgggagaggatgatcaaatttggaaaaaggacacatattaattgtggaagatgaagaaaaaatcgccagggttcttcagcttgaattggaatatgaaggatacagcgtcaccatcaaacaaaatggcacagaaggtctggatgcggcagcggagggcgggtattccttggtgcttcttgatgtcatgcttccggggcttagcggactggaagtgctgcgccgcttgagaaaaacggattcgcagacaccggtcatattattaacggcgcgagacagtattcctgataaggtaacaggtctggacatcggtgcaaatgactatgtcaccaagccgtttgaaatcgaggaattgcttgcgagaatcagggcggcgctgcgacaaaatggaacaaaaactgaagatatcggcacctttcttacatatgacgatttgcgggtgaacgaaaaaacccgtgaagtgagacgcggagacaaagaggtggaattaacgccgcgggaatttgatctgctcgtctatatgctaaagcatccgcagcaagtgctgacacgggagcaaattctaagctcggtatggggatttgattatatcggtgataccaatgtcgtggacgtctacataagatacatcagaaaaaaactggactatccttacgaaaaacagctgatccatacgattcgcggggtcggctatgccattaaggggtaaacgatgaagctgaagaccaagattcatctatacacttcgctatcactgttgattttattaattttggttcataccgcagtatatctcattttttcgtctgcgctgacatcaaaggatgcggcccggcttgctgatgagacggataacattgccgaagcgctgcgtgccgctgaaacagaaggagtggctttgcaggatatgctgcaggcctatcttccggcaaatggcatggtgcgtgtagtgaatggtgatcaaaaagccgttatgacgatcacaaaagaaaaagcctataaagattttcctctctcttttcatagcggagaaacggcagatgtgaggaaacatgacggcaagctgtttgccgaggctgctgttccggtgatttggaccgatggacaagtggtgtctcttcagctggttgaaaggctggagaacacagaagagagtctgtttctgctgaaaatcatcttaatcgctgcaagtgctgctgtctgcattgcttctttttttgcaggcagcttgcttgcccgccgtatcatcaatccgatcagacgattaatgatcacaatgaaagacatacagcgagacaaagaatttaaaacgatttctttagaaggacagtccaatgatgaattgtatcaaatggggctgacatttaatgaaatggcaatgatgctgaaggagcactatgataaacagcagcaatttgttcaagatgcttcacacgaattgaaaacgccgctcaccattatagaaagctacagcagcctgatgaagcggtggggggcaaaaaagccggaagtgcttgatgagtcgatagaagccattcactcagaagcggtgcatatgaaaaaactgaccaatcagcttttggcgctggccaaaagccatcaaggactcgaggttgatctgaaaacaatcgatctgattgaagcggcgcgcgcggttatgcaaacgctccagtccgtttatcagcgtgacatattgcttgaaacagataaagagagcctgcttgtaaaggctgatgaagaacgcatcaagcagctgttgaccattttgcttgataatgcaataaagtatagtgaaaagcctattgagatgtcagccggaacgaggaatggacggccatttctatcagtgagggatgaaggcatcggaatacctgaggagcatatcccgcatttgttcgaacggttctaccgggcagatgaggcacgaaacagaaaaacaggcggaacgggtttaggcctttctattgccaagcaaatcgctgatgagcatggcattgagctgtctgtcaaaagcaagccgggacaaggaacagctgtcaccatgcaattcagcgaacagaatgggggaggccgatgactaaaacaataaaaacagtatcttttgctgcagcagccattttagttgtcatcatctgtacgtttctcatcattcggcaaacccatgagaacgtattgtcaaaggagactgtcgtaaaaaaagtcgaagcctcttatgaaggcaaggtcacgaaagcaacacaatcaaaggataaaaaaacatatgatataacccttgaaaatccaaagggaacttactttgtaaaagcagacgcaatatcggctgacattctttcaatgaatagagtaaaagcagtgaatccatctgccatgacagaaaaagaagccgagcatctcgcgcttgagcgggtgccgggaacggtcaaaaaacaaacacggcaaagtcaagttgccacttatatcatacaaaaagaagacgggaaaacatacgaagtgaaggtagacatgcaggcaaaaacagtcttgtctgccgatcaaatcagcagcaaagatcaacaaaaaacgccgattacgaaaaaagaagccaaaacaattgcagagcgaaaaacgggcggcacagcggatgacgcagatctcgaagaaagtgagggcactctcatctttaaagtggacgttgatcttcctgatgataaggaagcgacagtgaaaatcaatgcctacacaggaaaggtagctaacattgtgtatgaagactgacggtttctcatcaaattctcatcttgctctcgttttcctttcatgttgagtgtgtaaactgtactcatacaaaacaaaggaggactcacaaatgctcaagaaaaaatggatggtcggtcttttagcagggtgcctagcggccggaggattcagctacaacgcgtttgccaaagaaaacaatgaaaacagacaggcttcttctaagacggatgcactcactgaacaagaagcagaagcaattgctaaaacagttgttgacggcacagtagaagacattgacagagacctttacaacggcaaagaagtctatgaagtggagattgaaaaagaaggtgaagactacgacgtttatgtagatattcatacaaaacaagcgcttaatgacccgctaaaggagaaagcagaacaagtcgccataaccaaagaagaagctgaagaaattgctttaaagcaaacaggcggaaccgtaacagaaagtaagcttgacgaagatgacggtgcttacatctatgaaatggaaatccaaacgaaacaaggaactgagacagaatttgaaatttccgcaaaagatggacgcattatcaaacaggagatagatgactaatcaaaacccccgctgcagcgggggtttttcatgataagaaaccttcttttggacaatctaagtagaaaaggaggcgaaacgcatggaaaagaaagaggagcaatacatcaatcaggctgaatatgtccctcatccgacgaaggaaggagagtatgccttatttcttcatgaaacgtatcatctgctttctgaagatgacgagacacaaacaacagaataagggcttaggcccttgttttgttccgtaattgtgatgtaagcgtatttattacttttttgagttgacacagcttgtttttttctgtaatctcagtgtgtcaattcaattaggaacttcgttaggtgaggctcctgtatggagatacgctgctgcccaaaaatgtccaaagacgccaatgggtcaacagaaatcatcgacataaggtgatttttaatgcagctggatgcttgtcctatgccatacagtgctaaagctctacgattgaaggcgcccgcacgctttttttgccgtgcttctttcaccttcaatcccgaaggctttttttatgcctttaaaacgaaaccaatcaaaggaggtgcggagtatggattctccccattcgagtcaatctgaagaagtacccatatactatgacagcaagacaattgattacacgatgaggagacgaactgccgcaccttctggcgaggccggcacgtctccgtagaggaggtacgagtcccgatggttcaaaacatgacctatgacgaactcattttacgcatcattattttactgcgagacgggaaaatcagggattttagaagtgttattgatgagcttcagccctatgacatggcatttatttttaaagaaatgccggaaaaacaccgcgcccgctatttatcttatttaactgtagacgatatcactgatatgatcggggagctggaacgcgaatttcagcttgtcgtcttaaataaagtcggaaaaacaaaagcaacactggcgatgaacaaaatggacaacgatgacctcgctcaattgcttgaagaaatggacgaagaactgaaggaacagcttttatccagcatggaagcgtcagaatcaaaagctgtacagctcttgatgaattacccggctgattcagcgggacgcatgatgacaaaccggtatgtgtggattcctcagcattacacggtaaaagacgcggtcgtcaaactgaaaagcttcgctgaaatagctgaatcgatcaactacttatatgttattaatgaaagcaaacagctggttggggttctttcctaccgcgatttgattctgggtgaacctgaagaaaaggtgcaggatttaatgtttacccgcgtcatatcagcagatgctcttcaggaccaggaagaagttgcccgcctgattgaacgttacgattttttggcaataccggttgtagaagaaaacaacgtgcttgtcggcattgtgacggtcgatgatattatcgacgtcgttattcgggaagctgatgaggattacgaaaaatttgccgcttccggtaaagacatcacctttgacacaaaagcttacgtggcggcataccggcgcctgccatggctgattttactcttgtttatcggactgatttcaggaagcattatcagctattttgaagacgcgctgaagcaggttgtcgcgcttgcgtttttcatgccgatggtgtcagggatgacaggaaatacgggaacacaatctctcgcggttgttatcagaggtttgtctaaagaagaaatgaacaaaaaaacgattgtgcgcctgatcttccgggagttcagaacaagtatttttatcggagcggtttgttctgtgctgattgcgattgtttctatcatatggcaggggaatgcgcttttgggatttgttgtcgcctcttcactgttcttaaccttaatcatcggcacgatgtcaggaacgattatccctattattttgcacaaactgaaagtagacccggcgattgcttctggaccgctgattacaacgttaaacgatattttatctttattaatctactttggcattgccactgcattcattcactcattataaacgtaaaaagtccgtctcaactgcgagccggacttttattatttaacggtttttgtaccgaaagtgagcattaagctgcccctccagcatttttttccgcacttgcggatcgttttttaacatctgttcttttttgcgcatatcctttaaaatctctgccgtctgtacgccgtcttcacgcttattggcgatatccatcagccgctccacatcggcaaaggagtattttcttgtcccccttgaagaacgctgcgggtaaatgagctttcgttcctcataatacctgatctgtcttacggacaatcctgtcaattcactcacaattccgattgaaatcacttttttgtctttataagaatgatcttctgtggtcatttttccacccctggatgtcttttgataatagtatataaaaaacaaagagaaaaaacctaacgcttgtcatattttctaacatcaaatagaagatttttgaaaaaatacggaagaaaaattaacaagaataatgcgtaacacccaagcacgttttatcctttatgtaacgaacaaacgaggaggaaggataatcatggaggaagaaaaagcggtctcactggcaaaagaaattatagagttggatatcaagcgtgatgaaatgctggagacgtttatgcagcttgccggagaacaggcttttcaattattaagatcggttcaaaacggacaataccgaaaatcttcgtaaacataaattctttacattagattcataccacgttcatttaaaaagagtatcttttgtataggatacctcaaaatgaaggaggacgctatgagtaatttattgaaatccgctttagaaaaagaacgacgccattattctgaaaaactctatcagattggggtttataataaagaggtcatgaacaaaatgacgatttctgagcttcggaaagaatacgcttatttctttcgaagcattacaaatcataaaaattatccttatacaagataatgtataaggatttttttgcttttagaaggaatttctcgaattatagcgaatacgtatagtaagggactgaactcttattatatgtaagggttttcattatttttttataaaaatcctatatacgaggtagatatgatgagattatcgtttaacgaagaagaagttgagcgtgcgatgaatttgtacagagtttttgcaagggctttcaaaagtgtgtccgaacatagtatccgtgatagcaaagagcacggttttaatcccactgaatttgctgtactggagctcctgtacacaagaggcccgcaaaaattacagcaaattgggtcgagacttctgcttgtaagcggaaacgtcacatatgttattgacaaactagaaagaaacgggtttttagtaagggagcaggacccgaaagataaacgctctgtttacgcacatttaactgacaagggaaatgagtatttggataaaatttatccgattcatgcactgcgtattgcgagagcgttttcaggtctttcgcctgatgaacaggaccagctgatcgtcctgctcaagaaagcaggcatacacagccagcatttgctgtttcgttaactattctacactctctatttcaggagagtgtttttttgtttccatatgattctttttaaaacatcttcaatcttcctatcagacatttcgccaaggtatccaatgacgtgttttttatactccttcatctgttcgttcgattgaaaaaatgccgcgatatactcttctgctttctgcatgtcccagtttctcatatctgtgacgagtttcttttcatgtagaaggtttaaattcatttcctcctgtcccggcagtgcatgataaataaataccggaagccgtttctgtaagcattcactgatggtcacgcctccgggtttagtcatgatgcctgtcgactgttcgtacaaacggttcatctctgctttgctgtgaaggtaaggaatcgcctcaatcaaggggtggtgtaaacttttgacataggagtagagcttttcgtttctgccgcataatattttgtataagatctttccgcctggcgacagttcctgcacccattttaaaatcccaccgacccccatactgccccctgtgatgatgatggtatatggcgggtggtgctgcaaggtatctgctgattccatttcaaaatttcggtgaactggaataccggtcaagtatatgttgttctgatcgatcccctctgatattagctgcttctttacttccgtgctcggaacaaaatggtaatcaatgttcttccgtccccataattgattcacgaaaaaatcagtgtatacattcacaaccgtcagattcggatattcaggctttagtcggttcagcagataagaaggcagcgcatgtgtgcagaaggcgatatcaggctgtttttcttggaggatgtgcctcatttgctgtgtgaacagccattcgtacatgaaaaagcgtttgtcatgctgaaattctccgcaggcgaggagcctgtaaatgccgctgtacgttttcgggaaatattgaatccattttaaataagccacggaggacaatttttctaaacggctatacgcatgtgaaaagatatcaatcttttcagctgccagcccttgagactctaattcagcctgcaatgcatcagccacatgatgatggccggtggaaatgcttaaaaaaggaaaaatgagaatgtttttcatgacagtcctcctaaaaaaatatggcaactatattttgaggagaacgttcacaaaatataagggtgtttttgatcataaggaaggtgaaaagatgaaaacttgtttcctttccatatggagagtggttgacccgatttatttctttttttcaaggctgaccttggttgacaaagatcgtaaaagcgtctttcgagtcaggctgacgaagtacaaaggacatcatgtcgtgcttagcgacggaacgcatataagaaaaaatgatgtgctcgttaaaatccacctgcataacataaagctgatcagggagctgcaaagcattgagagcgcagtcagaaagggaatcattatttatcagaaagtatatcaatcgatgccgcttcttttggattacatcaataatcacaaaaaaagtgaaaaaattaaagggattgtgggcattacaatgcttgacaaaggtgtggaaaggctcggttttgatgtggtcaccccggtcaaccctttttacaggtgctttaaaaagatcacacatataccgattttttatctcacttcaaagcaggtgagcttgcggcgtttaccgaatacatcctatttgtttatttcgaaagaaaagctgcagaaaacctatcaaaaaaaagactgatgccttggtcagcacagtcttttttgattatatctgatgaaacgtcacttcaggacggcttccgacacggatatttacgccggtttgtcccaagccctcgctgatataaaatggtttatcgtgatgataatgaaggcctttaatcatgttcattcgcacgaggtttcccattttcaccaaatgatacggttttggccagtgaatttgcccgccgtgaaaatgccctgacagcaggtaatcataatgaacatccttcatatccagaataatatttgggtcatgtgttaagacaagataatagccattttccagactttgataagagccggtgatattactccgattcgtactgtaatcatcaatgccgataatattgactggccctgcagccgtctcgattcgaacatgttcattttgcagcgtgatacagccgttttcctctaaaactcgcttcaatctctgaaagtcctcttctttcaatacataatcgtggttaccgaacaccgcgtacattccatatgcaggctttagcttttgcaaggcgttcaagtaacctgccagcttcggaatattacgtttccgatcaagaaaatccccggtaagagcaatgatgtccacaggctgatcttttgttaaatgatacagctcctcaggtgagactgaaatgttttccaagtgaagatctgataaatgaaggatatttaatttttttctggctggaaggccgtctttttggtcgattgaaatggtgttgactttcacatcttttgtattgcggttcgctttatatagaaatggcacaaatacgagtatggccaatgaaagtaagattgtaaacaaaatatatcccctcccttctatcagtatagtaagtgatcaagccctatggatagcgggaattaatgggtagagacaggttgaaaaacggattgtcatatgatgaatgatttggaagggaaaagggataataaattttgacacatgaggcagaacatgccgacggagtcagaataacaaatggatgtgtaagcaatgttacgattgatgagacaacaaaaaaaagaaacatattatctctggatcgcattatttcttcttttattgtatgtatccccgctttttattttaaaggaagatgcccatatccgggtccacgataatttagattccaacatcgcttggtacaaggttttggccgatagcggagaaatcgtcggcaaggttgacgctgccattccgcaaatcattaacgggctgccccgggatgcctttggcaccgagtggagcggaattgtttggctccatgctttcttttcttccatgaccgcctatgcaataagccagacggttacaagagttgtcgctttttttggaatgtatgtgctgctgaagaaacatataatcccggaaccaaaagcggctttcatccgaattggcgtatcgcttgcatttgccttaacaccgttctggccttcgggaatgctgagtacgcttgggtaccctttggcactgtgggcttttttaaatatccgaaaaggggatatttcatggagagagtggctgacgctgggcttgctccctctatactcaagctttgttctaggcttcttctttttcctggcagggatggcgtgtttttggctgtatgatgccattacaaaaagaagatggaatttgatgttcttaggcagtattgcatttatgacgagtatctatcttttcgttgaatatcggcttgtctattcgatgctgtttgaacacgcaccgatgcatcgtatcgaatttatctcatccaggcatgacgtttggcattctcttcggctatccgtaaaaaactttgtctatggccataatcatgtgatgaccgttcataccgttgtcatccttccgatcctgctggtcgtatttgctgctctgctgttcaaacgaaatcggacaaagccagaaaatgtttatctgtttttatgtgtgcttaattacggattgtcattatggtatgcgttttggttcaacaaaatttgggctgttccaaagcagaaatttgcctttttagcagaatttaattttgcccgttttcattttcttcggccgcttgttatatacgtgagctttgcgcttgctttatatctcatttggcggatggggaaaggatggaaatggcttgtgtacgccgcagtcgctgcacagctgatggtgttggcgccttttaatgaagaatatacgtatggcgttcattacaacgcgccgacattcaaggagttttatgcatcggagcaattcaaagagattaaggaatatatcggacgtccgcaggattcgtacagggtggcgagcatcggactgcatccgtctatcgcccaatataacgggttttatacgttagatacgtataacaatctgtatccgctttcatataaatatgaatttaggaaaatcatcgaaaaagagctggaaaaaaattctcggctgaaacaatactttgatgaatggggcagccgctgctacctttttgtcgatgaactcggtaaacgatatgatttcaaaaagaactcgaagaaaacgatcaacaaccttcaattaaatacagatgtatttaaaaaaatgggcggacggtacattttttcttcagttccgatcatgaatgctgaacaaaaccatctcgcgctcgtaaagacgtttgaccataaagattccgcctggcgcatttatttatatgaaacaagataaggaggatatcgattgaaacagtcacagccagtattaaccatcgtcgtcccgtgtttcaatgaagaggaagtgtttcaagaaacaagccgtcagctgacagaggttgtagatgatttaattgaagaaaaattaattgctgaagacagtaaaattctgtttgtcgatgatggcagcaaagaccgcacttgggctttgattgctatggagagcataagaaacaagaaggttaccggcttaaaattagcctgcaatgtcggccaccaaaaagcgcttttagccggactgcataaagcgaagaataggtcagactgcgtcatttcgatcgatgccgatcttcaggacgatatctctgtgatccgggattttatgctgaaatatcatgagggctgcgagatcgtttacggtgtacgccggagcagaaaaaccgatacctttttcaagcgcacgacagcgttagggttttatcgtctcatgaataagcttgggattaaattaatttataatcatgctgattttcgtttaatgaataaaaggtcccttgaagagcttgagcgttatccggaagcgaatctgtttttaagaggtattgtccccatgatcggctttaaatcggccgaagttttgtatgaccgcaaggaacgctttgccggcaaaacgaaatatccgctgaaaaagatgctatccttcgcttttaacgggattacttcattcagtgtcgcaccaattcgattctttacgcttttagggtttgttttgtttttcctcagcgctgtggcagggattggcgcgtttattcaaaagctgctcggccatacgaatgcaggctgggcgtctctcatcatatccatttggtttttgggcgggctgcaattgatgggaattggcatcatcggagagtatattggaacgattttttctgaagtgaaaagacgaccgaaatacgcgatcgatattgatttgtataatgaacagctgagcccgcttcagcgccaggaaaaagagcggttagaaaaaaagtacagttaaacacggaaagagctgacttcattagtcagctctttttcttcaactgatgcaatatggcgctaagcggttcgtcttgcgggttgcggtaaaaatcaaaaaatgggcagccctgctttttaattcgatcgatgaccgtatcaattgtaaacagagcgggtgttaaagatgattgcacctcatgccagtagagcggggctgcaacagtcccaagctcatttcctctcgtcgaatagggacagataatcgtttttccttctgcatgctgcaaataatcaagatacaatttgccgtgtctgtttttaatcaagcgttcagtggtaaatagctcgggaaatgcattggtgcagtactctgcgatcagctgcgtaaagtggcgtgtttcttcatacgtaaatgcctcgggagacaagggaatataaagctggatgcctttgttgccggacagcttcgggtacgatgtgatgccaaaggaatccaacagccgcttcagttcatttgcggcctgcacggccataagaaagtcatctcgcgaaggcgggtctaaatcaatgacaatctcagccggacgcctgcttttaatggtttgaaaaggaacgtgaaactccaaagcaagctggttgcaaagccatagcaatgtagacatatcctcacagacaatatgttcatggctcccatcatagaaagattgaacaaaatccg

(The sequence listing continues in the following parts.)

What is claimed is:

1. A method of producing a composition capable of degrading at least one polysaccharide, the method comprising,
   a) culturing strain *Bacillus subtilis* 6A-1 (6A-1), reference culture comprising said 6A-1 having been deposited at ATCC under deposit number PTA-125135, such that said 6A-1 produces at least two polysaccharide-degrading protein fractions;
   b) a process selected from (i) filtering or drying or freeze drying or grinding, or adding at least one excipient, carrier or diluent to said 6A-1 strain or cells or spores of said 6A-1 or (ii) extracting at least one polysaccharide-degrading protein fraction from said 6A-1, or iii) a combination thereof and
   c) producing a composition comprising said strain, cells, spores or at least one polysaccharide-degrading protein fraction extraction of b), or a combination thereof.

2. The method of claim 1, wherein said composition comprises at least three cellulose-degrading protein fractions produced by said 6A-1, said protein fractions capable of degrading crystalline cellulose, carboxymethyl cellulose and unmodified cellulose.

3. The method of claim 1, wherein said composition is capable of degrading protein at a pH of 2 to 12.

4. The method of claim 1, wherein said 6A-1 is an asporogenous mutant of said 6A-1.

5. The method of claim 1, wherein said composition is capable of degrading cellulose under conditions from pH 2 to pH 13.

6. The method of claim 1, wherein said composition is capable of degrading acid detergent fiber.

7. The method of claim 1, wherein said 6A-1 is cultured at a temperature of less than 55° C.

8. The method of claim 1, wherein said 6A-1 is cultured at a temperature of 30°-35° C.

9. The method of claim 1, wherein said 6A-1 is cultured in a liquid or semi-solid medium.

10. A method of producing an edible composition for an animal, the method comprising,
    a) culturing strain *Bacillus subtilis* 6A-1 (6A-1), reference culture comprising said 6A-1 having been deposited at ATCC under deposit number PTA-125135 such that said 6A-1 produces at least two polysaccharide-degrading protein fractions;
    b) a process selected from (i) filtering or drying or freeze drying or grinding, or adding at least one excipient, carrier or diluent to said 6A-1 strain or cells or spores of said 6A-1 or (ii) extracting at least one polysaccharide-degrading protein fraction from said 6A-1, or iii) a combination thereof; and
    c) producing an edible composition selected from
       (i) a composition comprising said strain, cells, spores or at least one polysaccharide-degrading protein fraction or combination thereof of b); or
       (ii) a composition comprising one or more plants or plant parts fermented with said strain, cells spores or at least one polysaccharide-degrading protein fraction or combination thereof of b) until said fermentation is complete.

11. The method of claim 10, wherein b) comprises drying said 6A-1 strain, cells, spores or at least one polysaccharide-degrading protein fraction or combination thereof and further comprises spraying said dried strain cells, spores or at least one polysaccharide-degrading protein fraction or combination thereof onto one or more plants or plant parts.

12. The method of claim 10, comprising producing a probiotic edible composition comprising said strain, cells, spores or at least one polysaccharide-degrading protein fraction or combination thereof of b).

13. A method of feeding an animal, the method comprising,
    a) culturing strain *Bacillus subtilis* 6A-1 (6A-1), reference culture comprising said 6A-1 having been deposited at ATCC under deposit number PTA-125135 such that said 6A-1 produces at least two polysaccharide-degrading protein fractions;
    b) a process selected from (i) filtering or drying or freeze drying or grinding, or adding at least one excipient, carrier or diluent to said 6A-1 strain or cells or spores of said 6A-1 or (ii) extracting at least one polysaccharide-degrading protein fraction from said 6A-1, or iii) a combination thereof;
    c) feeding said animal an edible composition selected from,
       (i) said strain, cells, spores or at least one polysaccharide-degrading protein fraction or combination thereof of b); or
       (ii) a composition comprising one or more plants or plant parts fermented with said strain, cells spores or at least one polysaccharide-degrading protein fraction or combination thereof of b) until said fermentation is complete.

14. The method of claim 13, wherein said polysaccharide degrading protein fractions retain said polysaccharide degrading activity at a pH of 2 to 13.

15. The method of claim 13, wherein said animal is selected from a lactating animal, ruminant, lactating ruminant, poultry, swine, equine, canine, feline, or rabbit.

16. The method of claim 13, wherein said edible composition comprises said plants or plant parts.

17. The method of claim 16, wherein dry matter digestibility, neutral detergent digestibility, acid detergent fiber digestibility or hemicellulose digestibility or a combination thereof of said edible composition is increased after said fermentation is complete.

18. The method of claim 16, wherein lactic acid is lower, pH is lower, or ammonia concentration lower, or a combination thereof of said edible composition after said fermentation is complete.

19. The method of claim 1, wherein said strain, cells, spores or at least one polysaccharide-degrading protein fraction is dried or freeze dried.

20. The method of claim 1, wherein said composition comprises said strain.

21. The method of claim 1, wherein said composition comprises said cells or spores.

22. The method of claim 1, wherein said at least one excipient, carrier or diluent is edible.

23. The method of claim 1, wherein said composition is edible.

* * * * *